United States Patent 11,446,398 (REGULATED BIOCIRCUIT SYSTEMS) - sequence listing, part 33

SEQ ID NO: 116997 - DNA, 2560 bp, Homo sapiens
  Payload ID: 2826
  Gene Symbol: CHEK2
  Gene Name: checkpoint kinase 2
  ENST ID: ENST00000416671
  CDS Start-End: 661-1284
cttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagagaaaatacttaaaatctactctctcagctgattttcaaaaatacggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 116998 - DNA, 1349 bp, Homo sapiens
  Payload ID: 2826
  Gene Symbol: CHEK2
  Gene Name: checkpoint kinase 2
  ENST ID: ENST00000433028
  CDS Start-End: 45-530
ggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaggaaaatttgtcctgtccttacagaatatggtttaagtgagtaaagatgagtaagttgctgggcgtggtggctcacacctgtaatcccagcactttgggaggctgaggcggatggatcacctgaggtcaggagttcgagaccagcctgacccacatggagaaaccctgtctctactaaaaatacaaaataagccgggcatggtggtgcatgcctgtaatcccagctattcgggaggctgaggcaggagaatcgcttgaacccgggaggcagaggttgcagtgagccaagatcgtgccattgcactctagcctgggcaacaagagtgaaactctgtctcaaaacaaaaaaaaagatgatttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaa

SEQ ID NO: 116999 - DNA, 1580 bp, Homo sapiens
  Payload ID: 2826
  Gene Symbol: CHEK2
  Gene Name: checkpoint kinase 2
  Uniprot ID: O96017
  ENST ID: ENST00000433728
  CDS Start-End: 1-870
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggt

SEQ ID NO: 117000 - DNA, 1532 bp, Homo sapiens
  Payload ID: 2826
  Gene Symbol: CHEK2
  Gene Name: checkpoint kinase 2
  Uniprot ID: O96017
  ENST ID: ENST00000448511
  CDS Start-End: 1-498
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaggaaaatttgtcctgtccttacagaatatggtttaatttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggt

SEQ ID NO: 117001 - DNA, 906 bp, Homo sapiens
  Payload ID: 2826
  Gene Symbol: CHEK2
  Gene Name: checkpoint kinase 2
  ENST ID: ENST00000439200
  CDS Start-End: 22-906
aggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagagaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggca

SEQ ID NO: 117002 - DNA, 1551 bp, Homo sapiens
  Payload ID: 2826
  Gene Symbol: CHEK2
  Gene Name: checkpoint kinase 2
  Uniprot ID: O96017
  ENST ID: ENST00000417588
  CDS Start-End: 1-612
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggt

SEQ ID NO: 117003 - DNA, 984 bp, Homo sapiens
  Payload ID: 2826
  Gene Symbol: CHEK2
  Gene Name: checkpoint kinase 2
  ENST ID: ENST00000434810
  CDS Start-End: 1-830
ctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 117004 - DNA, 425 bp, Homo sapiens
  Payload ID: 2826
  Gene Symbol: CHEK2
  Gene Name: checkpoint kinase 2
  ENST ID: ENST00000464581
  CDS Start-End: 13-425
caaacagggacaatggaaaggctgttatatggaattggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctca

SEQ ID NO: 117005 - DNA, 11133 bp, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENST ID: ENST00000266880
  CDS Start-End: 65-1936
ctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgagatggtgccttgctgtgttgcccaggctggtctaaaactcctgggatcaagtgatcctcccaccttggcctcccaaagtattgtgattacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctggggctgcctcacttccccatgcgagggaggcaggccccatgcagagtgagctccgagtgcctcactgctagtgatggtcactctgtcacctgctgtccctcagtgactcctgtgaaacctgctcaggtctcttcattctgccaatgctgggaagccacaacctgttcatccagtgtggaggctttgtcttcagctgagcaccagaagaagccacaatgcagagaccctgagtttgtgcaagggtggggctgagaggggaggtcccgtgttagtgcaggggtgaggccgggaggggaggtcccgagtttgtgtaggggcgaggctgagcagggaggttctgagttagtgcaggggcgaggctgagcagggaggtcccgagttagtgcaggggcgaggctaagggggaggtcccaagtttgtgcaggggtgaggctgagcagggaggtcccaagttagtgcaggggcgaggctgagaggggagatcccgagtttgtgcaggggcgaggctgagaggggaggtccctagttagtgcaggggtgaggccgagaagggaggtcccaagtttgtgcatggatgaagccaaaaggggagtttgcacgtttgtgcaggggtgaggccaagaagggaagtcttgagttggtgcaggggtgagggagaggggaggtcctgagtttgtgcagaggcgaggctgagaggggaggtccctaagtgcaggggtgaggccgagaggggaggttgcaaatttgtgcaggggtgaggccaagaggggaggtcctgagttagtgcgggggtgaggccgagaggggaggtcctgagtttgtgcagaggcgaggctgagaggggaggtccttagtgcaggggtgaggctgagagggggaggtcccaagtttgtgcaggggtgaggccgaggggaggttgcaagtttgtgcaggggtgaggccaagaggggaggtcctgagttagtgcgggggtgaggccgagaggggagttcctgagtttgtgcagaggcgaggctgagaggggaggttgccagtttgtgcaggtgcgaggctgagaggggaggctggcattcgccaatgaagtgggctggggctaccctgcgtctgtgtcttagagagatcggttgatactcactcttccccttcccatctccaaaaagtagaaacaagaacacttgccctgtagaggatgctggtctttcctcaggaccagctgcacctgtccaggaagggcaggcagctcagagagcctctgggctccaggtgtcctagggactcactcctgcttccttagtccttcagagaagtccaactcctggcccactgtgaagaggatttctacctggagcagtcggaacagcttgggtttggctgtgatgtgagggaggaggccttgggagcagggcagttatcctcccagcgtggtaaggagccgtgttttatggaggcagggagatcagggcagttactcctcgggtgtggtaaggagctgtgttttatggaagcaggtggccgtgaactcattccgtcttttcatgagcttctgtacttcctcgtcctcaagacccagccatcccacccagcaaaactgaccggctgtggtggttttggagccctgctctccttgtggggtggctgcgtgggtcgtccacaggctttctggaggacagcctggtgctgctgcagatcccactgcttcttcctggctccttggcccagccttgggacaaacccagggcagggctgcagctgcccgctggccccacagaccgtctccccacgcactcctcatctgcggctccctctgtgctccctggtgcccctcagaagcgggggtcagccctgcccacccctccgtgtgctgcccaggctccaagccagggaagggggcctcaggttctaggtgaacccgtccaccccagtgaggcctctctgggatggcctctgtcatagcttctgactgcagccaggaagtctgggcagattggcttaaaacagactgagggattcaggccaaccctcctccctaggccagctacaaaggctgttttaaatctgctttaagtcatcttaatgacctcagggccagcaggatgggagtggtcgggcccaggtgtgagagccggggtccaggggctgctcccagcaccacacggccttcaccccaggggtgtggccaaggcagagaggcagctgagtttggaaggggcttccgccagcaagggtttcctggtgacagccccccagcttcgggctggcaggctgggagagtggagcaatgctggccctgaggcagctgcagccggctccctgaagaggccccagagtcactgccagggccgctaggttgccgggagccctgcactgggaagggaaggaaagcatgagaacggaggggatttaggaaagtagatcgtccctccagcctggcttgatggggaaaccagaacgctgtccccgcggccgtgcccgccctctgcctccacgtgggctccgttttggcatgcacgctagctcctgcgccttctgagggcggctgcagccgtgtagagaagccgggtcttgcctccctgaggacggagggccgcatgcagagcacagcctagccctgcagatccgcgcgctgaccagcagcaggacggagccgggtgatcttcgggggagccacctccagaaacgcctagtgctggtaactggtagacagccattattcaagcatcctctacacttagaattgagttacactgaaaacaaaggtgatgagtgctcaggacgcactactttctagttagtttaccgcacctgcctgttacctgcaggcccgagggtgtgtgcttctgtggcctgtgtgggatggcaccccttccagccttacccactcagctcagttggcctggttggaatgggccctgggaggagtgtttgcactgtggaaattggtaaatgcttcaaatcagggtggtttttaattttgcttttgttttcttctgaagagaaggttgttaaacaccagcacagtgctgcaccaggcagccagcatataatcatgagaaataagtagttgtttaagccactgcatttggggtggtttattacatagtaatgataaccatatcatggcccttgaaggcccagcatgtatgacccctgcctccacccctcagaaaacctcttctccctacctgcttctcctggagcccctcaggtgttcctctgcttctccaccgaaccagctaattctcacaaacagcccctcaggtaccagcccctccctctgcagcctctcctcattcagctcctgcagggctgcccccaccccgccagccagtctagtttccccccagcacctgtcactatcggaaaggaaacatctgtttaccgtttgtctccccctctcaaaaaaatagagcagggatcttgcctgtctgcccactgttgtttatttgtctgaaatgtttggccccagggcagcatctactgatcactgaccagttggctactgaacggtgaaggtctgatgagctgatgagccgtcccctgggcttgaaatctttcccgcggcacaaacaggcgccccttcctctgtcgctcacttttcacggttgtctccttctgaggcggtgagtctagatggtggggtcttaaagttcctcacacagagcagacacttggtcgtgcatgtctgtggaaggaatggactcaggagagaatgttgaaggccagtcagaccaggagtgagtgccgtgcgccgtgctgggagcctgtcactgtgagtgccgtgcgccgtgctgggagcctgtcactgtgagtgccgtgcgccgtgctgggagcctgtcactgtgagtgccgtgcgccctgctgggagcctgtcactgtgagtgccgtgcgccgtgctgggagcctgtcactgtgagggccgagcgccgtgctgggagcctgtcactgtgagggccgtgcgccgtgctgggagcctgtcactgtgagggccgtgcgccgtgctgggagcctgtcactgtgagggccgtgcgccgtgctgggagcctggcactgtgagtgccgtgcgccgtgctgggagcctggcactgtgagggccgtgcgccgtgctgggagcctggcactgtgagtgccgtgcgccgtgctgggagcctgtcactgtgagtgccgtgcgccgtgctgggagcctgtcactgtgagtgccgtgcgccgtgctgggagcctggcactgtgagtgccgtgcgccgtgctgggagcctggcactgtgagtgccgtgcgccgtgctgggagcctggcactgtgagtgccgtgcgccgtgctgggagcctggcactctgagtgccgtgcgccgtgctgggagcctgtcactgtgagtgccgtgcgccgtgctgggagcctgtcactgtgagtgccgtgcgccgtgctgggagcctggcactgtgagtgccgtgcgccgtgctgggagcctatcactgtgagggccgtgcgctgtgctgggagcctggcactgtgagggccgtgcgctgtgctgggagcatgcatttgtgagacccgccctgcccagtgctggccttgaatgtgggtccacttgggccgctggatcaaaacgccgcagaacaggcggcttaaacaacagaaagtattttctcacagttctggggcctggaactctgagatcagggtgtcagcggggccggttcctctttggtctgtctccttggctcgtgggcagcatctccttgagttctcacgtcatcttctcttcatgcgtgtttgtgccctaatctcttcctgcgaggacaccagtcctattggattagggcccacaccagtggcctcattttatcttaatcacctctttaaagaccacacctactaaaactggaacgatatagagaagattagcatggcccacgtgcaggcatgacacccaaattcatgacgtgttccatgtctgcagatacagtcacctctgaggtcctgggatttagggcttgaacatattgtaacactctgccatcaaagctcgcacgccacggggttttataaaaattgggtggttttgtttgttgttgtttggcaaaccccacatgctggataccattgacactccgtggtgggctgagccatgtccccgtcccgccaccacagatacccgtatccgatcacttgagcctgtgatgatgttgccttgcaccgtaaaaggggctttgcagatatggtggaattaaggaccttgagatgaggggaggatcctggattagcttgtgggccctctgtgcaacagtaggagtcgttgtaagagggaagcaagaggccgggcgtggtggctcacgcctgtactcccagcactttgggaggctgaggcgggcggatcacgaggtcaggagatcgagaccatcctggctaacatggtgaaaccccgtctctactaaaaaataccaaaaaattagccgggcgtggtggtgggtgcctgtagtcccagctactcgggaggctgaggcaggagaatggcttgaacccgggaggcggagcttgcagtgaaccgagatcgcaccactgcactcccgcctgggcgacagagcgagactctatctcaaaaaaaaaaaaaaaaaaaaagcaagcaagaagtcaaaggcaggaagaggaggcttggtgacagagaagaggtgggagggatgtgctttgcagagggagcaagggcctccagccaggagaggagggcaggctgtcgaagcagaaaagaaaacagatctccctgcagggccaccagaaggaaccagccctgcctgccccttcattttggacttccgagctccagaactgcaagagaataaatctagtttaagcagcaaagttggtggtaacttcttagagcagccacaggaagctcactaccccccacacactcatcccgtttggtttttgttttcaggaagggtccagtctgtctcagaggtgctgtggttggaggtggagtgtggggcatggctgagcacccaacatccgcttcaccctctcccctgctccccagcacgttccttcaccctgtagctctaggtctctgtggcagacactcagctctaactgctgacctgatggctccacttggtgttcaaacatcccagattcatgttgtcaaagagagctgtttccagtggggaccccaggcccaccacgtacgcccggcagacctgccctctccactgtcagaagatggcatggcctccctgtagctcaggcccaaccccaggagtcatcctgctggctgtcctcagtgccccaggcttctcttcaggggcttcttgtggctctgattgttgccccctcacctcactgctcttctcccagatctgtgcgtgcattggtcctccttgtcacgcacgttcagctcaaatattacttcctcaaaggtgcctttgagtactcgttctccttgcctttccctctcctgggacactgttcccaccagtacctgcatgattccttttttttcttttccttttctttttttgtttttgagacagtgtcttgctctgttgtcagggctggagggcagtggcgcaatgtcagctcactgcagcctccacctcctgggctcagatgatcctcccacctcagcctcctgagtagctgggactacaggtgcacaccaccacacccagctaatttttagtagagagcagggtttcaccatgttgcccaggctggtcttgaactcctgagttcaagcgatctgcccgcctctacctcccacagtgctgggattccaggcgtaagccgccacgcccagcaactccgtttcttacttgttggctcacattctcctgagaagtcctccctcaaccatcggcctgaaatagcagcgagcctccccagggttgcctctgccttttcttgactctttctgtcaccttctatgcttgttgtctggtccccactagaatataccttctgtaagagcagggatttgggacagtgcctagaatagtacttgcagacagtaggctacgataaatatgaatgacggccccatgcagatggtagcccctctcgctcgaacgcttcacccagttttattttcttttcatcagttaccgccctctgaaggtatccacacacaaacatgaaactggaccaaagcagggaccccccgcacgcagaatagtgctgggctcgcgtaaggcacctcagtgggtccatcagctgatgcatggacagacaaaatgggtgtatccagacactggagtatcgtgcagcgaggaaacgtgctgagtgtggatggaccttaaacacaccatgcaagtgaaaaggcgtcacagaaggccacatacgatatgatcccatttctatgaaatgtccagaagaggcacattcataaagacagaaggtgactgagtggttgtcgggctgggtggaggggatagggagtgaatgcaagaaggatccttctgaggtaacggaagtatccggaaactgggttggagtgatgggtgcacagctctgcacatttactacagtcgctgaactgcacacacaacacgggtatattttattgcatagaaattgtattaaagctgttaagaattttacttagattagcatttttcccacactgtgccatcaacttagtatatgattagattcattgtttctaactgtatttaaatttaatgtttgtcacattttgcttgctaaatttttaaaattttaaattactgtgggtacataaaaggtgtatatatttatggagtaccttgatattttaatacagacatacaatgtataatgatcaactcccagtaactggggtatccatcacctcaagcctgtatcatttctttgttaggaacattccagttccactctttttgttatttaaaaatatacaatacattattattaactatattcaccctcctgtgctatggaatactagatcttatgctaattaaatgttttccctatttctccc

SEQ ID NO: 117006 - DNA, 2446 bp, Homo sapiens
  Payload ID: 2827
  Gene Symbol: CHFR
  Gene Name: checkpoint with forkhead and ring finger domains, E3 ubiquitin protein ligase
  ENST ID: ENST00000315585
  CDS Start-End: 340-1389
agaatgctgatattcaggccaggcacggtggctcatgcctgtaatcccagcagtttgggaggccaaaacaggaggatctcttgaccctgttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgtgtcgggcagacagtgctttcctgcgacatcattataaacaggtaacattgccccttcatctcggcagagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttc

SEQ ID NO: 117007 - DNA, 2648 bp, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENST ID: ENST00000432561
  CDS Start-End: 75-2069
gccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaa

SEQ ID NO: 117008 - DNA, 3250 bp, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENST ID: ENST00000450056
  CDS Start-End: 90-2048
ggatcagctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 117009 - DNA, 2990 bp, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENST ID: ENST00000443047
  CDS Start-End: 70-1788
aatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 117010 - DNA, 875 bp, Homo sapiens
  Payload ID: 2827
  Gene Symbol: CHFR
  Gene Name: checkpoint with forkhead and ring finger domains, E3 ubiquitin protein ligase
  ENST ID: ENST00000540963
  CDS Start-End: 205-875
cgagggggctgcggcgggcggcgaagggggacctggttgcggccgtgggagggggcgcccgccggcgtccaggccgggctgcggggctgcgtgggcgcgggcggccgggccggggcccgcggggtggggcgggcgccgagtctcggcctctggggtcgggagtctccatgggcgtttccggggtctccgcagatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccaga

SEQ ID NO: 117011 - DNA, 913 bp, Homo sapiens
  Payload ID: 2827
  Gene Symbol: CHFR
  Gene Name: checkpoint with forkhead and ring finger domains, E3 ubiquitin protein ligase
  ENST ID: ENST00000540537
  CDS Start-End: 838-913
tccaaagcccacgtccacacgttccgagcccgccgtcccatcgcaaacatccgggggccgccactgcgcctaacgaccgcccatctctgacgcctcgggtcggcgtttgatttttaacccaagaaaagagtaaaagtcaagcggaaatcaacgcagaagcggtgctgcagcctctgagcttcctgacggccgtgtccagagccgggctcctcctccggcggcagccgccgggctcacttcagtgcgctcagcttctcgcggggacaagcgtctgggcggggacggcccgaggcgggggtgtggcgaggctggagaacgctgaaagctggtgggcttgggaagacaaacgacgctctgaaatttggctcccagatctaagagccctttcttggagcctggactggaactcctctttttcctgtaacaatgacatcgcttctgatcgaagaacccacttcacagtaaatgaggtgcaccgtgggcccatgctcatggaattcatgggtcttgctgtgttctccatcatcctaccgattttggttctgtttttctggtggaactgactgagagaaacatatagtgaaaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgcctcggcctcttccacggagccttctcctgcagggcgagagcgttcctccagttgtg

SEQ ID NO: 117012 - DNA, 542 bp, Homo sapiens
  Payload ID: 2827
  Gene Symbol: CHFR
  Gene Name: checkpoint with forkhead and ring finger domains, E3 ubiquitin protein ligase
  ENST ID: ENST00000542714
  CDS Start-End: 328-542
cagggtgagggagcttggcttcctgagaagccacccaggagccccggcttggggatgacttgaggccgcgtcttcggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcg

SEQ ID NO: 117013 - DNA, 758 bp, Homo sapiens
  Payload ID: 2827
  Gene Symbol: CHFR
  Gene Name: checkpoint with forkhead and ring finger domains, E3 ubiquitin protein ligase
  ENST ID: ENST00000541817
  CDS Start-End: 349-758
attccgcccgcggcgtcgccacagggtgagggagcttggcttcctgagaagccacccaggagccccggcttggggatgacttgaggccgcgtcttcggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaacc

SEQ ID NO: 117014 - DNA, 584 bp, Homo sapiens
  Payload ID: 2827
  Gene Symbol: CHFR
  Gene Name: checkpoint with forkhead and ring finger domains, E3 ubiquitin protein ligase
  ENST ID: ENST00000536932
  CDS Start-End: 491-584
agttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgct

SEQ ID NO: 117015 - DNA, 746 bp, Homo sapiens
  Payload ID: 2827
  Gene Symbol: CHFR
  Gene Name: checkpoint with forkhead and ring finger domains, E3 ubiquitin protein ligase
  ENST ID: ENST00000535527
  CDS Start-End: 1-183
ctgcagcccaaagtcaggcggtctttttctgatgaagaagggagttcagaggacctgctggagctgtcagacgttgacagtgagtcctcagacattaggtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctcccca

SEQ ID NO: 117016 - DNA, 942 bp, Homo sapiens
  Payload ID: 2827
  Gene Symbol: CHFR
  Gene Name: checkpoint with forkhead and ring finger domains, E3 ubiquitin protein ligase
  ENST ID: ENST00000544093
  CDS Start-End: 1-226
agcggagcgcgagcaggacccgcgtgtcgcccctcagcagtgtgcggtctgcctgcagcctttctgccacctgtactggggctgcacccggaccggctgctacggctgcctggccccgttttgtgaatctgtaatgaaaagaaatatgtttatcctcagtgtcgggcagacagtgctttcctgcgacatcattataaacagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctac

SEQ ID NO: 117017 - DNA, 5283 bp, Homo sapiens
  Payload ID: 2828
  Gene Symbol: CMKLR1
  Gene Name: chemerin chemokine-like receptor 1
  Uniprot ID: Q99788
  ENST ID: ENST00000312143
  CDS Start-End: 365-1486
agtcccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccatgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaaaagggagctttaaatattgctcagtggcccccatctcccctcttcccacatttactgaggcacgagatgggatgggacctgtcccgggtcacagcagcagtcgtcagcgccttggccctcctggcttgtaggatgctgcttttcctgggcttctggcagtccaggccaggatgggggagccaggaattcatgttgtcattggaaaagctgataaacaggagcacaattcaaaccggctgttttcctccttagagtctggcctccctctttctggctgctctgtgggtcttcctgttctgacttaggttcctgtcaagtacttaaatgcagccttaacatcccatacagtcttgtccccacagcttcatgtgaacatctccatgggtcatgcatatatcgtccctgcagtgtgcaaagtgtgctcacctgcactgctgcacaggcaaccaacatacttagtgcccagagccttctctctgggcccaggactcagtgatggggccttacttagccctgcctcctgggtggggtgggggagctgagggatcgtgaggacaagaggtagagggaaaagaaaagaagatggtgtttgaggataggggagggacaggagaggggacagaaaggtcccagagcatgatgatgaaggaaagggatctggcattcatgaagcacctacgatggttcaggcacaaacactgaaacctcaaattggccctggcagaaggggaccatcatagcaaggtggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaga

SEQ ID NO: 117018 - DNA, 5110 bp, Homo sapiens
  Payload ID: 2828
  Gene Symbol: CMKLR1
  Gene Name: chemerin chemokine-like receptor 1
  Uniprot ID: Q99788
  ENST ID: ENST00000412676
  CDS Start-End: 192-1313
aaagtggaacaggtgtctgtgattctgcccacggaaggagacatggaggaggaagaggctgaggggaagatggaagaaggagggaaggaaggagaaatctttgcttttgggtaatcaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccatgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaaaagggagctttaaatattgctcagtggcccccatctcccctcttcccacatttactgaggcacgagatgggatgggacctgtcccgggtcacagcagcagtcgtcagcgccttggccctcctggcttgtaggatgctgcttttcctgggcttctggcagtccaggccaggatgggggagccaggaattcatgttgtcattggaaaagctgataaacaggagcacaattcaaaccggctgttttcctccttagagtctggcctccctctttctggctgctctgtgggtcttcctgttctgacttaggttcctgtcaagtacttaaatgcagccttaacatcccatacagtcttgtccccacagcttcatgtgaacatctccatgggtcatgcatatatcgtccctgcagtgtgcaaagtgtgctcacctgcactgctgcacaggcaaccaacatacttagtgcccagagccttctctctgggcccaggactcagtgatggggccttacttagccctgcctcctgggtggggtgggggagctgagggatcgtgaggacaagaggtagagggaaaagaaaagaagatggtgtttgaggataggggagggacaggagaggggacagaaaggtcccagagcatgatgatgaaggaaagggatctggcattcatgaagcacctacgatggttcaggcacaaacactgaaacctcaaattggccctggcagaaggggaccatcatagcaaggtggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaga

SEQ ID NO: 117019 - DNA, 1890 bp, Homo sapiens
  Payload ID: 2828
  Gene Symbol: CMKLR1
  Gene Name: chemerin chemokine-like receptor 1
  Uniprot ID: Q99788
  ENST ID: ENST00000552995
  CDS Start-End: 504-1619
ccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattc

SEQ ID NO: 117020 - DNA, 555 bp, Homo sapiens
  Payload ID: 2828
  Gene Symbol: CMKLR1
  Gene Name: chemerin chemokine-like receptor 1
  ENST ID: ENST00000549466
  CDS Start-End: 126-555
gtatttctccaaagaaactctggaaggagacatgaggaactaacatagggaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctcc

SEQ ID NO: 117021 - DNA, 632 bp, Homo sapiens
  Payload ID: 2828
  Gene Symbol: CMKLR1
  Gene Name: chemerin chemokine-like receptor 1
  ENST ID: ENST00000550573
  CDS Start-End: 192-632
aaagtggaacaggtgtctgtgattctgcccacggaaggagacatggaggaggaagaggctgaggggaagatggaagaaggagggaaggaaggagaaatctttgcttttgggtaatcaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcc

SEQ ID NO: 117022 - DNA, 1893 bp, Homo sapiens
  Payload ID: 2828
  Gene Symbol: CMKLR1
  Gene Name: chemerin chemokine-like receptor 1
  Uniprot ID: Q99788
  ENST ID: ENST00000550402
  CDS Start-End: 602-1723
gtttctctggctgagttctgtcccagtcccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatgtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttc

SEQ ID NO: 117023 - DNA, 1367 bp, Homo sapiens
  Payload ID: 2829
  Gene Symbol: XCL1
  Gene Name: chemokine (C motif) ligand 1
  Uniprot ID: P47992
  ENST ID: ENST00000367818
  CDS Start-End: 166-510
taagaaaaataaaagcatcagtattgcaaagactttccatgatcctacacccacctcgaaagccccctctcaccacaggaagtgcactgaccactggaggcataaaagaggtcctcaaagagcccgatcctcactctccttgcacagctcagcaggacctcagccatgagacttctcatcctggccctccttggcatctgctctctcactgcatacattgtggaaggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctagtagtctctggcaccctgtccgtctccagccagccagctcatttcactttacacgctcatggactgagtttatactcaccttttatgaaagcactgcatgaataaaattattcctttgtatttttacttttaaatgtcttctgtattcacttatatgttctaattaataaattatttattattaagaatagttccctagtctattcattatatttagggaaaggtagtgtatcattgttgtttgatttctgaccttgtacctctctttgatggtaaccataatggaagagattctggctagtgtctatcagaggtgaaagctatatcaatctctcttagagtccagcttgtaatggttctttacacatcagtcacaagttacagctgtgacaatggcaacaatttgagatgtatttcaacttgtctctataatagaattctgtttatagaataagggagaaaataatccagtcttcactgggttcccattctgagggtccactactcaaaaatttgcttcactcaatttttttcacctctttgtgttttattttggtgtcctattaaaggaataaaatgacacaacttgtcccttttttgtcccattagcaaaaattagaattttggtataaagaaactttattcaagtaaaaatcaataccctttgaattggacaataatctcactaccttattaggatttctgtatttgccattacgctagttatcatgcatgttatgctttactgcgaataagcttttaatgctccaaatgctgacccatgcaatatttcctcatgtgatcacaatttgcagtaaacttttaattaaatgctcatctggtaactcaacaccccag

SEQ ID NO: 117024 - DNA, 565 bp, Homo sapiens
  Payload ID: 2830
  Gene Symbol: XCL2
  Gene Name: chemokine (C motif) ligand 2
  Uniprot ID: Q9UBD3
  ENST ID: ENST00000367819
  CDS Start-End: 34-378
actctccctgcacagctcagcgggacctcagccatgagacttctcatcctggccctccttggcatctgctctctcactgcatacattgtggaaggtgtagggagtgaagtctcacataggaggacctgtgtgagcctcactacccagcgactgccagttagcagaatcaagacctacaccatcacggaaggctccttgagagcagtaatttttattaccaaacgtggcctaaaagtctgtgctgatccacaagccacgtgggtgagagacgtggtcaggagcatggacaggaaatccaacaccagaaataacatgatccagaccaagccaacaggaacccagcaatcgaccaatacagctgtgaccctgactggctagtagtctctggcaccctgtccgtctccagccagccagctcatttcactttacaccctcatggactgagattatactcaccttttatgaaagcactgcatgaataaaattattcctttgtatttttacttttaaatgtcttctgtattcacttatatgttctaattaataaattatttattattaagaa

SEQ ID NO: 117025 - DNA, 5281 bp, Homo sapiens
  Payload ID: 2831
  Gene Symbol: XCR1
  Gene Name: chemokine (C motif) receptor 1
  Uniprot ID: P46094
  ENST ID: ENST00000309285
  CDS Start-End: 358-1359
gttcatctggattcatggagtaggcgtttctattcaaacatgcaggctcttttctttatccagggcttgcagcttgattttcaggctgttcttggtttgaaggagttccaccaaggatccaccctaactgcctgcctgactggcttcttccttcctcctctctcactagctgtccccctctggccccctggctctctctgagactcctcccatcctcctcctccagccttctgggcaggacaggtgtttcagtttctttaagtgaaatatgaaacagagaagcaccatttctgcctcaagacgcatgtaaagaggtgtagattcagatgctctaaacgtccctgccatctggtccagatggagtcctcaggcaacccagagagcaccacctttttttactatgaccttcagagccagccgtgtgagaaccaggcctgggtctttgctaccctcgccaccactgtcctatactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactgaggggcctgtggcggtgcaggcgcaggtgcaggtggacagggactggaatgggggtcatggagaagcgggcctggaaggagcattgcagaacacagcagggtggagacgtctcctccgctgcaggcgtgcagtgaaggtcattcattacaccagtgggtcccgccagcctctcatctgcgggaaagtggcttcctacctgggaattttatactgccatccaaaaaaacatttcttgaactctgagttcatcttgcacgctccttcatttagacatgtgtttctaatcactgtttagttcagaaggttctaagacatgaaaggattctgggaaaggtgcttccttggagactttacagggcctaaagctcattgtgataactgcacgatgctgacaagacaatgcctcccttccctgactgtaaggttgtccctactggtttattcactttggaggcgcctggctccgtattcctcaggtactgctggatgaggctgtctggaagacaaaagtcgccataccctgagataagcagtcatgttgatatctggattctaaaaatccacaactagactggagaaatgttctgtatcctggattcaagtcctagcccacgaactggcccttaaaaatttagctcataaatatttgattgaaggaatgaatttaataagtgctaccttctgcactaagtatttattcagagaatacaaagatgaatgagatacagttgctaccctccaggggccaacagcccagctccaaaggctcacctaccttggtgaacacccaccttggtgaaggcatctagggtggactcctccgacatctcatccttcccaggtggatagtgagctgacttcacatttatcactttgtacctaaagtgtcctcctcctatttggttgatggtggtagctccccccacccacccacactccaaacctcaagtcctcttggaggcctgtgttttcttttcctcaactcccacagccaggtccaaatgactatgcctgtctagtggctttcagagttgactcattcttgccattgcatgcccatggtttcatccctgaaacagggcctcacttccttggcatctccccactgctcctctctttccccaccaggctgttctctgcccttacaccaggtgcttcaaaacccttagtggctcctcattacttacaaatgaagtccatacactttagcaaggctttcaaggcctccacaatccgatgccagccaacttttccattcttattccactctaagcctcctccccacagcagcttgggatccaaccccaaaacaccactggccttctttcagacacatatctccccagtaccctacctctaggcatttgtcatgctgtcacctgggcctggaacatgttctagctgacaggccagcttctccaggaagccctccctaatctgcaaattagaacattctctgggttgtcgtgggattctgcttgtcccctctaaaataaaacaaccttgtgttgtagttacacacatgcaatgtcttatctccctgccccatcaggctgcaagcttcttgagggcaggaacctggtcttgaaccccagtgttctatcactgtgtgctcagtgggagcaaagaatcaacagctgttattatccttcagatttatgcttcttggggagccatgccctggggcacactttaccttctttgtcccaggctgcttctctataaatattaacctttctttcctagtctacactctcagagagtagtagaaagagagtagggtgtagtagtagagagattgcttatctctctctgtggcgatggctatgcttcaccttgccttctagttcatggtacgcatccctgcctctcacactggcccattgcttcacacccaagggcataaataaaagccactctctaaactttgccatgccacaaagacctgggcccaatctgtgaacctgatttggctctggcgtggggatttggaaaagcttcccatgcgattctgacatgcaccttcattaggtacatttggctgcaacttttttaaaaaatgaggagtccagagtcttctacagtcccttgagcagggatttgcacacagaagacactcaatatcttgttattgaataaagtagataccaatgtagccctctggccaacctagagagagcttgtaaggcatttccccttcagttccagatgcaacttcaatgatctatttgccaatggggcagtagatctggaggagtttatcggtctagggaagagccagggcctagttttaataatgaggccagtagcacctgctggacagggctgggcggcataccagtgaagggaaggggctcccatggacctacctgccagcctacaggtggggccactactcaccaccgatgggagaaacagcataaggaagagataatgaggtagtttgtggtatcagagctaagcctatgggcttctagttggcctaatctttcaaacacagtttcacactgattcttaacattttgttcaacttttactcagagggcaggctgagccagggagcaaaaaggcaaaggactcctactcacatacccacttagcaaaaccaaagcaccttgggctttgaacccacccttcttagaaggcaggtttgggggttgaggccccttgagaagctcacttcaccctctccccatgccatcccattcctacccatcccaagatgcttctcttgtatttctttcagcacatccagccatctccctgggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccagagagttgcacaccatgagccacgctgtctgtccctgaccacaacctccactggccaccacctcctgggcttcccctccctccacccacagaaaccattgctcaatctcaactggactcttgcaggcctatctctccctccaaacagagatgtcctggacacagagctgcagacctctaaccactcctggaacataaaaaaacccacggtggttctacagcatttacacctccagtttccctcagacagaatccagaagagaagaacctcgctgatctctgagcggagcatgtctccaagctcaggccagccccagaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctggtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgtt

SEQ ID NO: 117026 - DNA, 332 bp, Homo sapiens
  Payload ID: 2831
  Gene Symbol: XCR1
  Gene Name: chemokine (C motif) receptor 1
  ENST ID: ENST00000395946
  CDS Start-End: 225-332
ctttaagtgaaatatgaaacagagaagcaccatttctgcctcaagacgcatgtaaagaggtgtagattcaggttggagtgcagtggcatgatcacagctctctgcagtctcgccctcctgggctcaagcaatctttccccaccccccggtttcctgagtagctgggactataggcatgcgccaccacacccggatgctctaaacgtccctgccatctggtccagatggagtcctcaggcaacccagagagcaccacctttttttactatgaccttcagagccagccgtgtgagaaccaggcctgggtctttgctaccctcgccaccactgtc

SEQ ID NO: 117027 - DNA, 592 bp, Homo sapiens
  Payload ID: 2832
  Gene Symbol: CCL1
  Gene Name: chemokine (C-C motif) ligand 1
  Uniprot ID: P22362
  ENST ID: ENST00000225842
  CDS Start-End: 71-361
agtggtgagctcttagcttcaccaggctcatcaaagctgctccaggaaggcccaagccagaccagaagacatgcagatcatcaccacagccctggtgtgcttgctgctagctgggatgtggccggaagatgtggacagcaagagcatgcaggtacccttctccagatgttgcttctcatttgcggagcaagagattcccctgagggcaatcctgtgttacagaaataccagctccatctgctccaatgagggcttaatattcaagctgaagagaggcaaagaggcctgcgccttggacacagttggatgggttcagaggcacagaaaaatgctgaggcactgcccgtcaaaaagaaaatgagcagatttctttccattgtgggctctggaaaccacatggcttcacctgtccccgaaactaccagccctacaccattccttctgccctgcttttgctaggtcacagaggatctgcttggtcttgataagctatgttgttgcactttaaacatttaaattatacaatcatcaacccccaaccctctgggtctcttggatttcagagtgaaaacttgattggcattgagaggtg

SEQ ID NO: 117028 - DNA, 1079 bp, Homo sapiens
  Payload ID: 2833
  Gene Symbol: CCL11
  Gene Name: chemokine (C-C motif) ligand 11
  Uniprot ID: P51671
  ENST ID: ENST00000305869
  CDS Start-End: 142-435
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgagggggacaaagatggctgtggccaagaggggcttggttaagggggtgggaactatgtccctgggaaatgagtttttggcttagctggtcttcattgaaatgcagggtgaaactgacaaacccattccagccctctattcccattttcaacagtatttcc

SEQ ID NO: 117029 - DNA, 851 bp, Homo sapiens
  Payload ID: 2834
  Gene Symbol: CCL13
  Gene Name: chemokine (C-C motif) ligand 13
  Uniprot ID: Q99616
  ENST ID: ENST00000225844
  CDS Start-End: 76-372
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccta

SEQ ID NO: 117030 - DNA, 669 bp, Homo sapiens
  Payload ID: 2834
  Gene Symbol: CCL13
  Gene Name: chemokine (C-C motif) ligand 13
  ENST ID: ENST00000577681
  CDS Start-End: 1-190
cgtcccatctacttgctgcttcacatttagcagtaagaagatctccttgcagaggctgaagagctatgtgatcaccaccagcagcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccta

SEQ ID NO: 117031 - DNA, 472 bp, Homo sapiens
  Payload ID: 2835
  Gene Symbol: CCL14
  Gene Name: chemokine (C-C motif) ligand 14
  Uniprot ID: Q16627
  ENST ID: ENST00000622526
  CDS Start-End: 1-330
atgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctc

SEQ ID NO: 117032 - DNA, 898 bp, Homo sapiens
  Payload ID: 2835
  Gene Symbol: CCL14
  Gene Name: chemokine (C-C motif) ligand 14
  Uniprot ID: Q16627
  ENST ID: ENST00000618404
  CDS Start-End: 110-391
attttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttgctggagcctggtacaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgctaggcagtctgtatgcattatcttatttaagcttcatgacaagtgtaaaagctacaaatcatcatttgattttttaggtaacacttcataaagggctctctatagca

SEQ ID NO: 117033 - DNA, 426 bp, Homo sapiens
  Payload ID: 2835
  Gene Symbol: CCL14
  Gene Name: chemokine (C-C motif) ligand 14
  ENST ID: ENST00000618060
  CDS Start-End: 27-224
ctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtgtagcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccc

SEQ ID NO: 117034 - DNA, 3265 bp, Homo sapiens
  Payload ID: 2835
  Gene Symbol: CCL14
  Gene Name: chemokine (C-C motif) ligand 14
  ENST ID: ENST00000614009
  CDS Start-End: 2408-2755
acatccagccttgagatcttttgctaagtgtgacacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacgtgagtgcaatgccttgtcttccttccaacctagagcctgcagggaaataagcaggagtgaggttggggctcaggggaagaccaggagcagggactcagaaaggagggctggtatcttcttgaaattgtgtgtatagcaacattatataaatgaattatctactgagcaccacagcacttcaccccatggtgtggtgagcaggatggagatgagacttaggactgtaggttctgcttaagagtttaagttgggatcttccagccttgaccaatgagacttgacttgggagactccaggcttcattccactaccccaaatgccctctagtctccaaataaacagatcctgaatctccaggcctcacatggccttgatctcttatcattgccccccaggaccagtccccccttgccctcaaggacatggagtgagaccagcctgcctctctactccctcaatttctctctctttgccgctaagcaaaagagtggcccaccccatttggggtatatttcctcagggagattaggagcagtgtcttgagcccctcaagggcatttttctattggcctcctgaggtttgggcccagcctgcttccagcgtcacctgtgcccagtgagtgcagcattgcttgggtatgggctggggggaaacacgacagtgtggggtccatcctaggcccccttttctcagctgatttcttagaataagctgcctttagagataaccaaaactatttatcactcttccattttacctactctccttttcagaaactggggggaaaccgaaggttgttaaaatacagctaaagttggtgggtatgtgcacagtttgacttgccctctccgatgtcatttgtcagctcagaggaacaaggtgggagagtataggagctctgactgggtctcaggaaacaggggccccttatgccgttctttggatcgtgaggatgctgcctggaatggagctggaaaacaggatgagacccttccacccagacatctggccaccctcagtgacctctgaggccattgtgatgcacatccatgattctatgaagcagggtcacataacatgcacacacctgatttctccactccataaccacaacatgtgcctgtttgtacagggctcttggcctacaatgtccttcctgctacctctataattcaagcttggggtggctgctgtcaccttgcttctcctataaaagccatgaaacttctcaatcagaaaatagatgaaaaaatcacccaatccagtgatttttaaaactttttagaccacaaaaccttttcttcaagcaatatcttccacagaggcccaatatgtaaaacagaaaaaatgggttgagtagggtacaagacaccactctcaaatgcagcaaggcctccacaatagtccctgaggcccccagagctccagggagctcagtgtaaaaaccactgatgcagtccaagggcctcatttacagaggagggaacagggggaaagtaaaatggccacagtacacaggaagcacaggcaaggttaggttaggatttgggtgccctgactctgtggcctttgtccttggggcttgctgtgggcatcctgctctctctgcaggttgtcggttcaatggggacatgggcagggtggagcactaggaggggctgggtttgcattcccaaatggcatgtctccaaatccctattgggatttcttccaaatattcctcctatttggagcacctttcccgaataaggcatgaaggctgcatgatattggccaagtccctagccttctctgccagtcggcccccagagatggtgtaagaagatctgagtgtgctgctcttcaatcctggagttgaaagtcatccaccagtctttccaagaggggttgaagaaaaggaggaagggtgattgatgatgagggaggagaaaaagaagagcccaggagtaccatggagaaggagaagagaagatgaggaaagcctactctcccctccaagttctgaggggctgtctcctccttccttccctcctccatgccctcagcttgcaggagcagccaatggtatggcctttaacaaggggcccctcctcagcatctgatgctctctcctcagggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttgctggagcctggtacaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgctaggcagtctgtatgcattatcttatttaagcttcatgacaagtgtaaaagctacaaatcatcatttgattttttaggtaacacttcataaagggctctctatagcagtc

SEQ ID NO: 117035 - DNA, 472 bp, Homo sapiens; identical to SEQ ID NO: 117031
  Payload ID: 2835
  Gene Symbol: CCL14
  Gene Name: chemokine (C-C motif) ligand 14
  Uniprot ID: Q16627
  ENST ID: ENST00000619040
  CDS Start-End: 1-330

SEQ ID NO: 117036 - DNA, 426 bp, Homo sapiens; identical to SEQ ID NO: 117033
  Payload ID: 2835
  Gene Symbol: CCL14
  Gene Name: chemokine (C-C motif) ligand 14
  ENST ID: ENST00000620991
  CDS Start-End: 27-224

SEQ ID NO: 117037 - DNA, 898 bp, Homo sapiens; identical to SEQ ID NO: 117032
  Payload ID: 2835
  Gene Symbol: CCL14
  Gene Name: chemokine (C-C motif) ligand 14
  Uniprot ID: Q16627
  ENST ID: ENST00000632700
  CDS Start-End: 110-391

SEQ ID NO: 117038 - DNA, 3265 bp, Homo sapiens; identical to SEQ ID NO: 117034
  Payload ID: 2835
  Gene Symbol: CCL14
  Gene Name: chemokine (C-C motif) ligand 14
  ENST ID: ENST00000633434
  CDS Start-End: 2408-2755

SEQ ID NO: 117039 - DNA, 1080 bp, Homo sapiens
  Payload ID: 2836
  Gene Symbol: CCL15
  Gene Name: chemokine (C-C motif) ligand 15
  Uniprot ID: Q16663
  ENST ID: ENST00000614050
  CDS Start-End: 554-895
tctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaattttttaactttgcttgagttttaagaggaaataaactaatataaaactgaa

SEQ ID NO: 117040 - DNA, 1073 bp, Homo sapiens
  Payload ID: 2836
  Gene Symbol: CCL15
  Gene Name: chemokine (C-C motif) ligand 15
  Uniprot ID: Q16663
  ENST ID: ENST00000617897
  CDS Start-End: 547-888
tctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaattttttaactttgcttgagttttaagaggaaataaactaatataaaactgaa

SEQ ID NO: 117041 - DNA, 718 bp, Homo sapiens
  Payload ID: 2836
  Gene Symbol: CCL15
  Gene Name: chemokine (C-C motif) ligand 15
  ENST ID: ENST00000614368
  CDS Start-End: 1-185
gctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctagatctgagcctggaacaggtgttgcagagaagcagaaaaagagaggactcacaccagttgactcttgtggcatgattttggatgtggcattggagctggtctctctaggattctacctcggcctcccaggttcaagcaattctcctgcctcagcctccctactagctgggattacgtgcctgccaccagacctgactaatttctgtatttttagtagagacagggtttcgccttgttggtcaggctggtctcaaactcctaacctcagatgatccacccacctcggcctcccaaagtactggaattaacggcatgagccactgcactcagcctctacctacttttcaagccttcctgatactacctaaaatctttgcagtaaagtcctttttgcttaatcaaccagagtcagtttgtatagctttccaacaaaaaactccaactgatatgaacaataaactttctgggactttgaaggtctaaaaa

SEQ ID NO: 117042 - DNA, 718 bp, Homo sapiens; identical to SEQ ID NO: 117041
  Payload ID: 2836
  Gene Symbol: CCL15
  Gene Name: chemokine (C-C motif) ligand 15
  ENST ID: ENST00000631730
  CDS Start-End: 1-185

SEQ ID NO: 117043 - DNA, 1506 bp, Homo sapiens
  Payload ID: 2837
  Gene Symbol: CCL16
  Gene Name: chemokine (C-C motif) ligand 16
  Uniprot ID: O15467
  ENST ID: ENST00000611905
  CDS Start-End: 77-439
gttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcccgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaaacatgcaataaataaaactcccttatttgaca

SEQ ID NO: 117044 - DNA, 687 bp, Homo sapiens
  Payload ID: 2837
  Gene Symbol: CCL16
  Gene Name: chemokine (C-C motif) ligand 16
  ENST ID: ENST00000613642
  CDS Start-End: 1-287
aagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaaacatgcaataaataaaactcccttatttgacagcttga

SEQ ID NO: 117045 - DNA, 1634 bp, Homo sapiens
  Payload ID: 2837
  Gene Symbol: CCL16
  Gene Name: chemokine (C-C motif) ligand 16
  ENST ID: ENST00000610493
  CDS Start-End: 42-203
tcattcggctctccctgaagctgtactgcctcgctgagaggatgaaggtctccgaggctgccctgtctctccttgtcctcatccttatcattacttcggcttctcgcagccagccaagttggagcgcagtgtcgcgatctcggctcaccacaacctccgcctcccgagttcaagtgattctcctgcctcagcctcctgagtagctgggatcacaggcacacaccaccacgcccagctaatttttgtatttttatagagacggggtttcaccatgttggccaggctggtctcaaacttctgacctcaggtgatccgcccgcctcggcctcccaaagtgctgggattacagaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcccgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatga

SEQ ID NO: 117046 - DNA, 1506 bp, Homo sapiens
  Payload ID: 2837
  Gene Symbol: CCL16
  Gene Name: chemokine (C-C motif) ligand 16
  Uniprot ID: O15467
  ENST ID: ENST00000621559
  CDS Start-End: 77-439
gttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgaca

SEQ ID NO: 117047 - DNA, 1634 bp, Homo sapiens
  Payload ID: 2837
  Gene Symbol: CCL16
  Gene Name: chemokine (C-C motif) ligand 16
  ENST ID: ENST00000631489
  CDS Start-End: 42-203
tcattcggctctccctgaagctgtactgcctcgctgagaggatgaaggtctccgaggctgccctgtctctccttgtcctcatccttatcattacttcggcttctcgcagccagccaagttggagcgcagtgtcgcgatctcggctcaccacaacctccgcctcccgagttcaagtgattctcctgcctcagcctcctgagtagctgggatcacaggcacacaccaccacgcccagctaatttttgtatttttatagagacggggtttcaccatgttggccaggctggtctcaaacttctgacctcaggtgatccgcccgcctcggcctcccaaagtgctgggattacagaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatga

SEQ ID NO: 117048 - DNA, 687 bp, Homo sapiens
  Payload ID: 2837
  Gene Symbol: CCL16
  Gene Name: chemokine (C-C motif) ligand 16
  ENST ID: ENST00000633277
  CDS Start-End: 1-287
aagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgacagcttga

SEQ ID NO: 117049 - DNA, 615 bp, Homo sapiens
  Payload ID: 2838
  Gene Symbol: CCL17
  Gene Name: chemokine (C-C motif) ligand 17
  Uniprot ID: Q92583
  ENST ID: ENST00000219244
  CDS Start-End: 130-414
gctcagagagaagtgactttgagctcacagtgtcaccgcctgctgatgggagagctgaattcaaaaccagggtgtctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 117050 - DNA, 550 bp, Homo sapiens
  Payload ID: 2838
  Gene Symbol: CCL17
  Gene Name: chemokine (C-C motif) ligand 17
  Uniprot ID: Q92583
  ENST ID: ENST00000616880
  CDS Start-End: 65-349
agcagggtgtctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 117051 - DNA, 1324 bp, Homo sapiens
  Payload ID: 2839
  Gene Symbol: CCL18
  Gene Name: chemokine (C-C motif) ligand 18 (pulmonary and activation-regulated)
  Uniprot ID: P55774
  ENST ID: ENST00000616054
  CDS Start-End: 64-333
gccaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggctacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgacgactctgttgattttgtttcactaatcggaatcacagactgagaggaattctgggggaggagtagggaaatatgaaaaggggcagaaacagcaagatagggaccaagtacttctacagtcataccagacatttccctggagatactttcctgaaaagttgaaacagacaccattagtttataaaccatattgtaactgaaatgtgatagaaaaattttctacttaaatgaatatcaagatgacgctgcaatgcatatttacgcacacaagctcattttcataaatgaagctttcctcagaatgatggctaacatctgttgaggtcttaccaagtgctgggttttgggctaagtacttatattagtaaaagtctagcaaatactgcccatagtctagcaaggactccttacctggaagttgctgaaagccttggtaatgttatctttgttctccactctgcttttggggaggatgttttccatgactatacgagatgaggcttggggctgggtggccagagttagcaaataaaaatacagaatggatacta

SEQ ID NO: 117052 - DNA, 1324 bp, Homo sapiens
  Payload ID: 2839
  Gene Symbol: CCL18
  Gene Name: chemokine (C-C motif) ligand 18 (pulmonary and activation-regulated)
  Uniprot ID: P55774
  ENST ID: ENST00000614828
  CDS Start-End: 64-333
gccaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgacgactctgttgattttgtttcactaatcggaatcacagactgagaggaattctgggggaggagtagggaaatatgaaaaggggcagaaacagcaagatagggaccaagtacttctacagtcataccagacatttccctggagatactttcctgaaaagttgaaacagacaccattagtttataaaccatattgtaactgaaatgtgatagaaaaattttctacttaaatgaatatcaagatgacgctgcaatgcatatttacgcacacaagctcattttcataaatgaagctttcctcagaatgatggctaacatctgttgaggtcttaccaagtgctgggttttgggctaagtacttatattagtaaaagtctagcaaatactgcccatagtctagcaaggactccttacctggaagttgctgaaagccttggtaatgttatctttgttctccactctgcttttggggaggatgttttccatgactatacgagatgaggcttggggctgggtggccagagttagcaaataaaaatacagaatggatacta

SEQ ID NO: 117053 - DNA, 1324 bp, Homo sapiens; identical to SEQ ID NO: 117051
  Payload ID: 2839
  Gene Symbol: CCL18
  Gene Name: chemokine (C-C motif) ligand 18 (pulmonary and activation-regulated)
  Uniprot ID: P55774
  ENST ID: ENST00000615723
  CDS Start-End: 64-333

SEQ ID NO: 117054 - DNA, 687 bp, Homo sapiens
  Payload ID: 2840
  Gene Symbol: CCL19
  Gene Name: chemokine (C-C motif) ligand 19
  Uniprot ID: Q99731
  ENST ID: ENST00000311925
  CDS Start-End: 139-435
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaattg

SEQ ID NO: 117055 - DNA, 414 bp, Homo sapiens
  Payload ID: 2840
  Gene Symbol: CCL19
  Gene Name: chemokine (C-C motif) ligand 19
  ENST ID: ENST00000378800
  CDS Start-End: 66-380
tcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaaggcaagcctggccctccctggccctgtctcctccctctgagctcctgtctaagattccagcccatgatccttcc

SEQ ID NO: 117056 - DNA, 741 bp, Homo sapiens
  Payload ID: 2841
  Gene Symbol: CCL2
  Gene Name: chemokine (C-C motif) ligand 2
  Uniprot ID: P13500
  ENST ID: ENST00000225831
  CDS Start-End: 66-365
gagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaa

SEQ ID NO: 117057 - DNA, 736 bp, Homo sapiens
  Payload ID: 2841
  Gene Symbol: CCL2
  Gene Name: chemokine (C-C motif) ligand 2
  ENST ID: ENST00000580907
  CDS Start-End: 66-263
gagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatgtgagttcagcacaccaaccttccctggcctgaagttcttccttgtggagcaagggacaagcctcataaacctagagtcagagagtgcactatttaacttaatgtacaaaggttcccaatgggaaaactgaggcaccaagggaaaaagtgaaccccaacatcactctccacctgggtgcctattcagaacaccccaatttctttagcttgaagtcaggatggctccacctggacacctataggagcagtttgccctgggttccctccttccacctgcgttcctcctctagctcccatggcagccctttggtgcagaatgggctgcacttctagaccaaaactgcaaaggaacttcatctaactctgtcctccctccccacagcttcaagaccattgtggccaaggagatctgtgctgaccccaagcagaagtgggttcaggattccatggaccacctggacaagcaaacccaaactc

SEQ ID NO: 117058 - DNA, 800 bp, Homo sapiens
  Payload ID: 2842
  Gene Symbol: CCL20
  Gene Name: chemokine (C-C motif) ligand 20
  Uniprot ID: P78556
  ENST ID: ENST00000358813
  CDS Start-End: 59-349
cactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatatt

SEQ ID NO: 117059 - DNA, 839 bp, Homo sapiens
  Payload ID: 2842
  Gene Symbol: CCL20
  Gene Name: chemokine (C-C motif) ligand 20
  Uniprot ID: P78556
  ENST ID: ENST00000409189
  CDS Start-End: 71-358
agaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattgaaaataaagaaacaaaaagttcttctgtt

SEQ ID NO: 117060 - DNA, 852 bp, Homo sapiens
  Payload ID: 2843
  Gene Symbol: CCL21
  Gene Name: chemokine (C-C motif) ligand 21
  Uniprot ID: O00585
  ENST ID: ENST00000259607
  CDS Start-End: 59-463
cttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccacccaa

SEQ ID NO: 117061 - DNA, 599 bp, Homo sapiens
  Payload ID: 2843
  Gene Symbol: CCL21
  Gene Name: chemokine (C-C motif) ligand 21
  ENST ID: ENST00000378792
  CDS Start-End: 4-378
gacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggtgaggaatctgagggatgtgggtaaaggggagcctcagtcagcccctcacacccctcttctgccctcacaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctgg

SEQ ID NO: 117062 - DNA, 2929 bp, Homo sapiens
  Payload ID: 2844
  Gene Symbol: CCL22
  Gene Name: chemokine (C-C motif) ligand 22
  Uniprot ID: O00626
  ENST ID: ENST00000219235
  CDS Start-End: 46-327
tatgtccctttgcagacacctgggctgagacatacaggacagagcatggatcgcctacagactgcactcctggttgtcctcgtcctccttgctgtggcgcttcaagcaactgaggcaggcccctacggcgccaacatggaagacagcgtctgctgccgtgattacgtccgttaccgtctgcccctgcgcgtggtgaaacacttctactggacctcagactcctgcccgaggcctggcgtggtgttgctaaccttcagggataaggagatctgtgccgatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctgttctccaaacccatactacacatcccacttctgggtctttgcctgggatgttgctgacacccagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactccctttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccaccccccccccaacttttttttttttttatggcagggtctcactctgtcgcccaggctggagtgcagtggcgtgatctcggctcactacaacctcgacctcctgggttcaagcgattctcccaccccagcctcccaagtagctgggattacaggtgtgtgccactacggctggctaatttttgtatttttagtagagacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtggagctttcctggccctgggaggaagctggctgtggtagcgtagcgctctctctctctgtctgtggcaggaggcaaagagtagggtgtaattgagtgaaggaatcctgggtagagaccattctcaggtggttgggccaggctaaagactgggatttgggtctatctatgcctttctggctgatttttgtagagacggggttttgccatgttacccaggctggtctcaaactcctgggctcaagcgatcctcctggctcagcctcccaaagtgctgggattacaggcgtgagtcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctaccacaggcactagaaggacgaatctgcctactgcccatgaacggggccctcaagcgtcctgggatctccttctccctcctgtcctgtccttgcccctcaggactgctggaaaataaatcctttaaaatagt

SEQ ID NO: 117063 - DNA, 402 bp, Homo sapiens
  Payload ID: 2845
  Gene Symbol: CCL23
  Gene Name: chemokine (C-C motif) ligand 23
  ENST ID: ENST00000613876
  CDS Start-End: 1-42
tttgaaacgaacagcgagtgctccaagccgggtgtcatgtaggtgccaagctcaccaaacatgtgttgagggagaaggactctgtagcatcttgcagggaggacctgatagactggtgtccatcagggcccaccctctggatcctgccagcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcacttt

SEQ ID NO: 117064 - DNA, 624 bp, Homo sapiens
  Payload ID: 2845
  Gene Symbol: CCL23
  Gene Name: chemokine (C-C motif) ligand 23
  Uniprot ID: P55773
  ENST ID: ENST00000615050
  CDS Start-End: 72-485
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacatgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcactt

SEQ ID NO: 117065 - DNA, 624 bp, Homo sapiens
  Payload ID: 2845
  Gene Symbol: CCL23
  Gene Name: chemokine (C-C motif) ligand 23
  Uniprot ID: P55773
  ENST ID: ENST00000610342
  CDS Start-End: 72-485
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacatgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcactt

SEQ ID NO: 117066 - DNA, 569 bp, Homo sapiens
  Payload ID: 2845
  Gene Symbol: CCL23
  Gene Name: chemokine (C-C motif) ligand 23
  Uniprot ID: P55773
  ENST ID: ENST00000612516
  CDS Start-End: 66-428
tcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacagattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcactttt

SEQ ID NO: 117067 - DNA, 569 bp, Homo sapiens
  Payload ID: 2845
  Gene Symbol: CCL23
  Gene Name: chemokine (C-C motif) ligand 23
  Uniprot ID: P55773
  ENST ID: ENST00000632633
  CDS Start-End: 66-428
tcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacagattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcactttt

SEQ ID NO: 117068 - DNA, 402 bp, Homo sapiens
  Payload ID: 2845
  Gene Symbol: CCL23
  Gene Name: chemokine (C-C motif) ligand 23
  ENST ID: ENST00000631414
  CDS Start-End: 1-42
tttgaaacgaacagcgagtgctccaagccgggtgtcatgtaggtgccaagctcaccaaacatgtgttgagggagaaggactctgtagcatcttgcagggaggacctgatagactggtgtccatcagggcccaccctctggatcctgccagcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcacttt

SEQ ID NO: 117069 - DNA, 582 bp, Homo sapiens
  Payload ID: 2846
  Gene Symbol: CCL24
  Gene Name: chemokine (C-C motif) ligand 24
  Uniprot ID: O00175
  ENST ID: ENST00000222902
  CDS Start-End: 92-451
actctgcaaggacccgagctatttatccctaggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtg

SEQ ID NO: 117070 - DNA, 585 bp, Homo sapiens
  Payload ID: 2846
  Gene Symbol: CCL24
  Gene Name: chemokine (C-C motif) ligand 24
  Uniprot ID: O00175
  ENST ID: ENST00000416943
  CDS Start-End: 95-454
acttggcaccaaggctgtcaccctgttacctccgggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtg

SEQ ID NO: 117071 - DNA, 953 bp, Homo sapiens
  Payload ID: 2847
  Gene Symbol: CCL25
  Gene Name: chemokine (C-C motif) ligand 25
  Uniprot ID: O15444
  ENST ID: ENST00000253451
  CDS Start-End: 107-556
ggacagcttggcctacagcccggcgggcatcagctcccttgacccagtggatatcggtggccccgttattcgtccaggtgcccagggaggaggacccgcctgcagcatgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataactttt

SEQ ID NO: 117072 - DNA, 450 bp, Homo sapiens
  Payload ID: 2847
  Gene Symbol: CCL25
  Gene Name: chemokine (C-C motif) ligand 25
  ENST ID: ENST00000315626
  CDS Start-End: 1-450
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagtaagaggaatgtctccctcctgatatcagctaattcaggtaag

SEQ ID NO: 117073 - DNA, 924 bp, Homo sapiens
  Payload ID: 2847
  Gene Symbol: CCL25
  Gene Name: chemokine (C-C motif) ligand 25
  Uniprot ID: O15444
  ENST ID: ENST00000390669
  CDS Start-End: 51-503
gtggccccgttattcgtccaggtgcccagggaggaggacccgcctgcagcatgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatgga

SEQ ID NO: 117074 - DNA, 744 bp, Homo sapiens
  Payload ID: 2847
  Gene Symbol: CCL25
  Gene Name: chemokine (C-C motif) ligand 25
  ENST ID: ENST00000458625
  CDS Start-End: 1-255
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatcaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatggagtca

SEQ ID NO: 117075 - DNA, 526 bp, Homo sapiens
  Payload ID: 2848
  Gene Symbol: CCL26
  Gene Name: chemokine (C-C motif) ligand 26
  Uniprot ID: Q9Y258
  ENST ID: ENST00000005180
  CDS Start-End: 82-366
cagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttga

SEQ ID NO: 117076 - DNA, 703 bp, Homo sapiens
  Payload ID: 2848
  Gene Symbol: CCL26
  Gene Name: chemokine (C-C motif) ligand 26
  Uniprot ID: Q9Y258
  ENST ID: ENST00000394905
  CDS Start-End: 259-543
agaacctcagaaatgtgagttatttgggaatggctgtttgtaaatgtccttacgtaagccaagaggaggtcttgacttggggtcccaggggtaccgcagatcccagggactggagcagcactagcaagctctggaggatgagccaggagtctggaattgaggctgagccaaagaccccagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttga

SEQ ID NO: 117077 - DNA, 446 bp, Homo sapiens
  Payload ID: 2849
  Gene Symbol: CCL27
  Gene Name: chemokine (C-C motif) ligand 27
  Uniprot ID: Q9Y4X3
  ENST ID: ENST00000259631
  CDS Start-End: 60-398
cccagataaaaggtaggggaggaggagagagagagaaggaagagtctaggctgagcaacatgaaggggcccccaaccttctgcagcctcctgctgctgtcattgctcctgagcccagaccctacagcagcattcctactgccacccagcactgcctgctgtactcagctctaccgaaagccactctcagacaagctactgaggaaggtcatccaggtggaactgcaggaggctgacggggactgtcacctccaggctttcgtgcttcacctggctcaacgcagcatctgcatccacccccagaaccccagcctgtcacagtggtttgagcaccaagagagaaagctccatgggactctgcccaagctgaattttgggatgctaaggaaaatgggctgaagcccccaatagccaaataataaagcagcattggataataatttctga

SEQ ID NO: 117078 - DNA, 3126 bp, Homo sapiens
  Payload ID: 2850
  Gene Symbol: CCL28
  Gene Name: chemokine (C-C motif) ligand 28
  Uniprot ID: Q9NRJ3
  ENST ID: ENST00000361115
  CDS Start-End: 76-459
aggacacctttagcctcatttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaaaaatgaacaattgtgcggtatgcaaatgtagccaataatatactcaactggaaaatgaaatgaaaagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttttggtgttataacttgacataccctaaaataaagacatttttctacataatcaccttatcagttttatacctaaaaaattaataatttcatctaatatattccatattcaaattttcccaactatttagagagcattttatgtagtttttttttcactccagtaatcaatcaaggttgacatacatattgcaaataattgttatttttctttaatatctttcaatctaagaaagttcctctgtcttttttttttaatttttaaaattattttgttgagggagggtcttgctgtgtcttccaggctggagtgcagtggcacaattttgattttggctcactgaagcctcaacttctagggctcaagcaatcctcccacctcagcctcccgagtatctgggatcaaggtgcatacccaccacacctggctaattttgtttattttttgtagagacagggtctcactatgttgcccaggttgatctcaaactcctgggctcaagcgatcctcccaccttagcctcccaaagtactgggattataggtgtgagccacagtgcctggcctaattattttcttgtgatcaaattcaggtttaatgtttttggttaagaatttcctacgtgaattcgtgtacttattttgtcatttagagttcataaatattagggtttattttctaaatagaatagtttaaactaaatataacttcaaaacgtctagtttgagtagctaccgttgtttggattgaaattttctgatactgaaaagaacaaaaagcctgcctttctgcccagaaccttttgcctcccccagtcagttcttggagcagcactagttaggggcccagagttcggccttctgtgtggtgattttacgctctgcctaaacaaggagcctacatcttttagctcctattccacccttctcacacgtttttgttgttgtttggttgtttttttttgagacagagtctcactctgttgcccaggctggagtgcagtggcacaatctcggctcattgcaacctccgcctcccgcgttcaagtgattctcttgcctcagcctcccaagtaactgatattacaggcgcccagccaccacaccccgctgatttttgtatttttagtagagacggggttttcccacgttggccgggctggtctcaaactcttgacctcaagtgaaccacccgcctgtgcctcccaaagtgctggaattaccagcgtgagccaccatgccgggctcacacgtttgagttgataccattgtgccattcctcttttggcctcttttttgtccatagaggcttcaagatagataggtaagagcccagtagtgttcataagaagccaatagagagcaggagccactttatcaggtggcaggtgtcctgggcctccctgctggctagtcccaagcggtggtgttgccaggatgtcttggaggtgataatgggacacacagaggcactgagtctccataggttaaaatgccaccaaaactggcctttgcctaatatccctcattgactatttagcatttaatttatttattttcctgacatttctgcaagctttgtatttatatttccactttatagatgaggaaatttgaggctcttagaggtaaaatgacttgcccaggtcacacaggaagtggcagagacaagctttttaaataagaaaaaattaataaaatataatatgagagtaacttaaaatattaataaaccacaattttaaattaattaaccgtgataaccaacattaataaaagttaagataccaaaacactggtgtctaattctttcaactaacaacttgaattattttccattttaaattaattaaccgtgataaccaacattaataaaagttaagataccaaaa

SEQ ID NO: 117079 - DNA, 1518 bp, Homo sapiens
  Payload ID: 2850
  Gene Symbol: CCL28
  Gene Name: chemokine (C-C motif) ligand 28
  ENST ID: ENST00000513525
  CDS Start-End: 308-550
cccgcggtaggctaggcctggtcctgggcgccccagccggctcccccgggtccaggcgtgcgcctgcgggcgacgtgcgcgtctgggcatccggccgtcacgcgctgcctgggactccaccctacctacccttcgcgtagtacttgttatactttggcagcttcttcacgtcggtcctctccgcgcgcgggtaggaaccgtccacggccttaaagaagcctcctcaccagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaaaaatgaacaattgtgcggtatgcaaatgtagccaataatatactcaactggaaaatgaaatgaaaagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttttggtgttataacttgacataccctaaaataaagacatttttctacataatcaccttatcagttttatacctaaaaaattaataatttcatctaatatattccatattcaaattttcccaactatttagagagcattttatgtagtttttttttcactccagtaatcaatcaaggttgacatacatattgc

SEQ ID NO: 117080 - DNA, 1342 bp, Homo sapiens
  Payload ID: 2850
  Gene Symbol: CCL28
  Gene Name: chemokine (C-C motif) ligand 28
  Uniprot ID: Q9NRJ3
  ENST ID: ENST00000489442
  CDS Start-End: 60-443
catttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttagtctcactctatcacacaggctggagggcagtggcaggatctcagttcaccccaacctttgcctcacgggttcaagggattctcgtgcctcagccttccaagtagctgggattacaggtgtgcgccagtacgcctggctagttttagtattttttgttacagacggggtttcaccatgttggctgggctggtctcaaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaa

SEQ ID NO: 117081 - DNA, 778 bp, Homo sapiens
  Payload ID: 2851
  Gene Symbol: CCL3
  Gene Name: chemokine (C-C motif) ligand 3
  Uniprot ID: P10147
  ENST ID: ENST00000613922
  CDS Start-End: 84-362
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggtaaa

SEQ ID NO: 117082 - DNA, 778 bp, Homo sapiens; identical to SEQ ID NO: 117081
  Payload ID: 2851
  Gene Symbol: CCL3
  Gene Name: chemokine (C-C motif) ligand 3
  ENST ID: ENST00000613396
  CDS Start-End: 84-362

SEQ ID NO: 117083 - DNA, 778 bp, Homo sapiens; identical to SEQ ID NO: 117081
  Payload ID: 2851
  Gene Symbol: CCL3
  Gene Name: chemokine (C-C motif) ligand 3
  Uniprot ID: P10147
  ENST ID: ENST00000616221
  CDS Start-End: 84-362

SEQ ID NO: 117084 - DNA, 784 bp, Homo sapiens
  Payload ID: 2852
  Gene Symbol: CCL3L1
  Gene Name: chemokine (C-C motif) ligand 3-like 1
  Uniprot ID: P16619
  ENST ID: ENST00000612067
  CDS Start-End: 86-367
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctccacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggtaaa

SEQ ID NO: 117085 - DNA, 784 bp, Homo sapiens
  Payload ID: 2853
  Gene Symbol: CCL3L3
  Gene Name: chemokine (C-C motif) ligand 3-like 3
  Uniprot ID: P16619
  ENST ID: ENST00000615140
  CDS Start-End: 86-367
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggtaaa

SEQ ID NO: 117086 - DNA, 784 bp, Homo sapiens; identical to SEQ ID NO: 117084
  Payload ID: 2853
  Gene Symbol: CCL3L3
  Gene Name: chemokine (C-C motif) ligand 3-like 3
  Uniprot ID: P16619
  ENST ID: ENST00000619989
  CDS Start-End: 86-367

SEQ ID NO: 117087 - DNA, 784 bp, Homo sapiens; identical to SEQ ID NO: 117084
  Payload ID: 2853
  Gene Symbol: CCL3L3
  Gene Name: chemokine (C-C motif) ligand 3-like 3
  Uniprot ID: P16619
  ENST ID: ENST00000621940
  CDS Start-End: 86-367

SEQ ID NO: 117088 - DNA, 667 bp, Homo sapiens
  Payload ID: 2854
  Gene Symbol: CCL4
  Gene Name: chemokine (C-C motif) ligand 4
  ENST ID: ENST00000621600
  CDS Start-End: 80-358
agcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 117089 - DNA, 552 bp, Homo sapiens
  Payload ID: 2854
  Gene Symbol: CCL4
  Gene Name: chemokine (C-C motif) ligand 4
  ENST ID: ENST00000613036
  CDS Start-End: 80-238
agcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 117090 - DNA, 897 bp, Homo sapiens
  Payload ID: 2854
  Gene Symbol: CCL4
  Gene Name: chemokine (C-C motif) ligand 4
  Uniprot ID: P13236
  ENST ID: ENST00000617322
  CDS Start-End: 317-595
agtctcggtcactgcctttggctgtaccacttcccttttcttctcgcctgcacctccctcatctttcctctatgatgacatcgccctggggaagagaagctgagaggaactcctcactcagctagcttcaggagcatgacgtcatctctaccatggaaattccactcactctcctgtgcccccacatttgtcctaggcctcagagtccctataaagagagattcccaagtcagtatcagcacaggacacagctgggttctgaagcttctgagttctgcagcctcacctctgagaaaacctctttgccaccaataccatgaagctctgcgtgactgtcctgtctctcctcatgctagtagctgccttctgctctccagcgctctcagcaccaatgggctcagaccctcccaccgcctgctgcttttcttacactgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 117091 - DNA, 552 bp, Homo sapiens; identical to SEQ ID NO: 117089
  Payload ID: 2854
  Gene Symbol: CCL4
  Gene Name: chemokine (C-C motif) ligand 4
  ENST ID: ENST00000621626
  CDS Start-End: 80-238

SEQ ID NO: 117092 - DNA, 904 bp, Homo sapiens
  Payload ID: 2854
  Gene Symbol: CCL4
  Gene Name: chemokine (C-C motif) ligand 4
  Uniprot ID: P13236
  ENST ID: ENST00000615863
  CDS Start-End: 317-595
agtctcggtcactgcctttggctgtaccacttcccttttcttctcgcctgcacctccctcatctttcctctatgatgacatcgccctggggaagagaagctgagaggaactcctcactcagctagcttcaggagcatgacgtcatctctaccatggaaattccactcactctcctgtgcccccacatttgtcctaggcctcagagtccctataaagagagattcccaagtcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 117093 - DNA, 552 bp, Homo sapiens
  Payload ID: 2854
  Gene Symbol: CCL4
  Gene Name: chemokine (C-C motif) ligand 4
  ENST ID: ENST00000610612
  CDS Start-End: 80-238
agcacaggacacagctgggttctgaagcttctgagttctgcagcctcacctctgagaaaacctctttgccaccaataccatgaagctctgcgtgactgtcctgtctctcctcatgctagtagctgccttctgctctccagcgctctcagcaccaaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 117094 - DNA, 513 bp, Homo sapiens
  Payload ID: 2855
  Gene Symbol: CCL4L2
  Gene Name: chemokine (C-C motif) ligand 4-like 2
  ENST ID: ENST00000611486
  CDS Start-End: 235-513
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtcccatgggattctaatctaggcaagcaagtctgcgctgaccccagtgagtcctgggtccaggagtacgtgtatgacctggaactgaactga

SEQ ID NO: 117095 - DNA, 667 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000620063
  CDS Start-End: 80-358
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117096 - DNA, 667 bp, Homo sapiens; identical to SEQ ID NO: 117095
  Payload ID: 2855
  Gene Symbol: CCL4L2
  Gene Name: chemokine (C-C motif) ligand 4-like 2
  Uniprot ID: Q8NHW4
  ENST ID: ENST00000620708
  CDS Start-End: 80-358

SEQ ID NO: 117097 - DNA, 652 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000620576
  CDS Start-End: 80-343
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117098 - DNA, 836 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000620098
  CDS Start-End: 80-391
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtttacagggagtctgcttccagtgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117099 - DNA, 537 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000622783
  CDS Start-End: 80-223
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaaaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117100 - DNA, 1258 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000617416
  CDS Start-End: 80-274
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtgtgagtatcaacccctggctgccctgggaggcaagggtgagggctggatttttaaagggggcctgttttggggagggggtgatgagcgttggggaggcagctctcagggctgaagccttccctgacagcagtgaggtcacaggtcatgaactcacttttcaagtgctgaaggcggctgagtggcagccgagacagaagggggttcctggggaggaagttattcagaggacagggaagcaggggaaggcagacaggtcccgtgagatatggaccaattccttaaaccatgctagaaaaacatgtggaaaagtcactaccaggctggcagggaatggggcaatctattcatactgattgcaatgcccactggttcctaatctgggcaacccctggggcccacagctaaatccagtgagtggaagttacagggagtctgcttccagtgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117101 - DNA, 537 bp, Homo sapiens; identical to SEQ ID NO: 117099
  Payload ID: 2855
  Gene Symbol: CCL4L2
  Gene Name: chemokine (C-C motif) ligand 4-like 2
  Uniprot ID: Q8NHW4
  ENST ID: ENST00000620055
  CDS Start-End: 80-223

SEQ ID NO: 117102 - DNA, 552 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000616729
  CDS Start-End: 80-238
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaaattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117103 - DNA, 856 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000620732
  CDS Start-End: 80-274
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtctaaatccagtgagtggaagttacagggagtctgcttccagtgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117104 - DNA, 954 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000614182
  CDS Start-End: 219-509
ctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggttgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117105 - DNA, 954 bp, Homo sapiens; identical to SEQ ID NO: 117104
  Payload ID: 2855
  Gene Symbol: CCL4L2
  Gene Name: chemokine (C-C motif) ligand 4-like 2
  Uniprot ID: Q8NHW4
  ENST ID: ENST00000615418
  CDS Start-End: 219-509

SEQ ID NO: 117106 - DNA, 846 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000617405
  CDS Start-End: 80-391
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggttgagtggaagttacagggagtctgcttccagtgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117107 - DNA, 667 bp, Homo sapiens; identical to SEQ ID NO: 117095
  Payload ID: 2855
  Gene Symbol: CCL4L2
  Gene Name: chemokine (C-C motif) ligand 4-like 2
  Uniprot ID: Q8NHW4
  ENST ID: ENST00000620250
  CDS Start-End: 80-358

SEQ ID NO: 117108 - DNA, 785 bp, Homo sapiens
  Payload ID: 2855
  Gene Symbol: CCL4L2
  Gene Name: chemokine (C-C motif) ligand 4-like 2
  ENST ID: ENST00000616100
  CDS Start-End: 80-340
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117109 - DNA, 667 bp, Homo sapiens; identical to SEQ ID NO: 117095
  Payload ID: 2855
  Gene Symbol: CCL4L2
  Gene Name: chemokine (C-C motif) ligand 4-like 2
  ENST ID: ENST00000613828
  CDS Start-End: 80-358

SEQ ID NO: 117110 - DNA, 741 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000613173
  CDS Start-End: 80-286
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaactaaatccagtgagtggaagttacagggagtctgcttccagtgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117111 - DNA, 785 bp, Homo sapiens; identical to SEQ ID NO: 117108
  Payload ID: 2855
  Gene Symbol: CCL4L2
  Gene Name: chemokine (C-C motif) ligand 4-like 2
  Uniprot ID: Q8NHW4
  ENST ID: ENST00000610565
  CDS Start-End: 80-340

SEQ ID NO: 117112 - DNA, 815 bp, Homo sapiens
  Payload ID: 2855
  Gene Symbol: CCL4L2
  Gene Name: chemokine (C-C motif) ligand 4-like 2
  ENST ID: ENST00000631808
  CDS Start-End: 80-370
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggttgctgctccgggaaggatcccatccaccagagctgccccacatggaccatggtcaggcagaggaagatgcctaccacaggcaagggataaagccagatgacctcaaaggtcccatgggattctaatctgtctgctccttgttctacggattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117113 - DNA, 856 bp, Homo sapiens; identical to SEQ ID NO: 117103
  Payload ID: 2855
  Gene Symbol: CCL4L2
  Gene Name: chemokine (C-C motif) ligand 4-like 2
  Uniprot ID: Q8NHW4
  ENST ID: ENST00000634191
  CDS Start-End: 80-274

SEQ ID NO: 117114 - DNA, 836 bp, Homo sapiens; identical to SEQ ID NO: 117098
  Payload ID: 2855
  Gene Symbol: CCL4L2
  Gene Name: chemokine (C-C motif) ligand 4-like 2
  ENST ID: ENST00000633849
  CDS Start-End: 80-391

SEQ ID NO: 117115 - DNA, 846 bp, Homo sapiens
  Payload ID: 2855
  Gene Symbol: CCL4L2
  Gene Name: chemokine (C-C motif) ligand 4-like 2
  ENST ID: ENST00000632903
  CDS Start-End: 80-391
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggttgagtggaagttacagggagtctgcttccagtgctgctcgaggaaggatcccatccaccagagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117116 - DNA, 652 bp, Homo sapiens; identical to SEQ ID NO: 117097
  Payload ID: 2855
  Gene Symbol: CCL4L2
  Gene Name: chemokine (C-C motif) ligand 4-like 2
  Uniprot ID: Q8NHW4
  ENST ID: ENST00000632416
  CDS Start-End: 80-343

SEQ ID NO: 117117 - DNA, 741 bp, Homo sapiens
  Payload ID: 2855
  Gene Symbol: CCL4L2
  Gene Name: chemokine (C-C motif) ligand 4-like 2
  ENST ID: ENST00000633574
  CDS Start-End: 80-286
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaactaaatccagtgagtggaagttacagggagtctgcttccagtgctgctcgaggaaggatcccatccaccagagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117118 - DNA, 836 bp, Homo sapiens; identical to SEQ ID NO: 117098
  Payload ID: 2855
  Gene Symbol: CCL4L2
  Gene Name: chemokine (C-C motif) ligand 4-like 2
  Uniprot ID: Q8NHW4
  ENST ID: ENST00000631554
  CDS Start-End: 80-391

SEQ ID NO: 117119 - DNA, 836 bp, Homo sapiens
  Payload ID: 2855
  Gene Symbol: CCL4L2
  Gene Name: chemokine (C-C motif) ligand 4-like 2
  ENST ID: ENST00000634014
  CDS Start-End: 80-391
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtttacagggagtctgcttccagtgctgctcgaggaaggatcccatccaccagagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117120 - DNA, 1258 bp, Homo sapiens; identical to SEQ ID NO: 117100
  Payload ID: 2855
  Gene Symbol: CCL4L2
  Gene Name: chemokine (C-C motif) ligand 4-like 2
  ENST ID: ENST00000631768
  CDS Start-End: 80-274

SEQ ID NO: 117121 - DNA, 785 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000634078
  CDS Start-End: 80-340
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117122 - DNA, 652 bp, Homo sapiens; identical to SEQ ID NO: 117097
  Payload ID: 2855
  Gene Symbol: CCL4L2
  Gene Name: chemokine (C-C motif) ligand 4-like 2
  Uniprot ID: Q8NHW4
  ENST ID: ENST00000632699
  CDS Start-End: 80-343

SEQ ID NO: 117123 - DNA, 537 bp, Homo sapiens; identical to SEQ ID NO: 117099
  Payload ID: 2855
  Gene Symbol: CCL4L2
  Gene Name: chemokine (C-C motif) ligand 4-like 2
  ENST ID: ENST00000632480
  CDS Start-End: 80-223

SEQ ID NO: 117124 - DNA, 741 bp, Homo sapiens; identical to SEQ ID NO: 117110
  Payload ID: 2855
  Gene Symbol: CCL4L2
  Gene Name: chemokine (C-C motif) ligand 4-like 2
  Uniprot ID: Q8NHW4
  ENST ID: ENST00000633927
  CDS Start-End: 80-286

SEQ ID NO: 117125 - DNA, 846 bp, Homo sapiens; identical to SEQ ID NO: 117106
  Payload ID: 2855
  Gene Symbol: CCL4L2
  Gene Name: chemokine (C-C motif) ligand 4-like 2
  Uniprot ID: Q8NHW4
  ENST ID: ENST00000634027
  CDS Start-End: 80-391

SEQ ID NO: 117126 - DNA, 785 bp, Homo sapiens; identical to SEQ ID NO: 117108
  Payload ID: 2855
  Gene Symbol: CCL4L2
  Gene Name: chemokine (C-C motif) ligand 4-like 2
  Uniprot ID: Q8NHW4
  ENST ID: ENST00000631782
  CDS Start-End: 80-340

SEQ ID NO: 117127 - DNA, 537 bp, Homo sapiens; identical to SEQ ID NO: 117099
  Payload ID: 2855
  Gene Symbol: CCL4L2
  Gene Name: chemokine (C-C motif) ligand 4-like 2
  Uniprot ID: Q8NHW4
  ENST ID: ENST00000631660
  CDS Start-End: 80-223

SEQ ID NO: 117128 - DNA, 815 bp, Homo sapiens
  Payload ID: 2855
  Gene Symbol: CCL4L2
  Gene Name: chemokine (C-C motif) ligand 4-like 2
  ENST ID: ENST00000631972
  CDS Start-End: 80-370
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggttgctgctcgaggaaggatcccatccaccagagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117129 - DNA, 846 bp, Homo sapiens; identical to SEQ ID NO: 117106
  Payload ID: 2855
  Gene Symbol: CCL4L2
  Gene Name: chemokine (C-C motif) ligand 4-like 2
  ENST ID: ENST00000633309
  CDS Start-End: 80-391

SEQ ID NO: 117130 - DNA, 1258 bp, Homo sapiens; identical to SEQ ID NO: 117100
  Payload ID: 2855
  Gene Symbol: CCL4L2
  Gene Name: chemokine (C-C motif) ligand 4-like 2
  Uniprot ID: Q8NHW4
  ENST ID: ENST00000633550
  CDS Start-End: 80-274

SEQ ID NO: 117131 - DNA, 856 bp, Homo sapiens
  Payload ID: 2855
  Gene Symbol: CCL4L2
  Gene Name: chemokine (C-C motif) ligand 4-like 2
  Uniprot ID: Q8NHW4
  ENST ID: ENST00000632710
  CDS Start-End: 80-274
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtctaaatccagtgagtggaagttacagggagtctgcttccagtgctgctcgaggaaggatcccatccaccagagctgccccacatggaccatggtcaggcagaggaagatgcctaccacaggcaagggataaagccagatgacctcaaaggtcccatgggattctaatctgtctgctccttgttctacagattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 117132 - DNA, 856 bp, Homo sapiens; identical to SEQ ID NO: 117103
  Payload ID: 2855
  Gene Symbol: CCL4L2
  Gene Name: chemokine (C-C motif) ligand 4-like 2
  ENST ID: ENST00000633897
  CDS Start-End: 80-274

SEQ ID NO: 117133 - DNA, 719 bp, Homo sapiens
  Payload ID: 2856
  Gene Symbol: CCL5
  Gene Name: chemokine (C-C motif) ligand 5
  ENST ID: ENST00000605509
  CDS Start-End: 1-451
ggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtccacaggtcaaggatgccaaagagagagggacagcaagtctggcaggatttcctgtatgactcccggctgaacaagggcaagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagct

SEQ ID NO: 117134 - DNA, 1365 bp, Homo sapiens
  Payload ID: 2856
  Gene Symbol: CCL5
  Gene Name: chemokine (C-C motif) ligand 5
  Uniprot ID: P13501
  ENST ID: ENST00000603197
  CDS Start-End: 204-479
atttccggaggctatttcagttttcttttccgttttgtgcaatttcacttatgataccggccaatgcttggttgctattttggaaactccccttaggggatgcccctcaactggccctataaagggccagcctgagctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaa

SEQ ID NO: 117135 - DNA, 1244 bp, Homo sapiens
  Payload ID: 2856
  Gene Symbol: CCL5
  Gene Name: chemokine (C-C motif) ligand 5
  Uniprot ID: P13501
  ENST ID: ENST00000605140
  CDS Start-End: 83-358
tggatgagggaaaggaggtaagatctgtaatgaataagcaggaactttgaagactcagtgactcacctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaa

SEQ ID NO: 117136 - DNA, 1365 bp, Homo sapiens; identical to SEQ ID NO: 117134
  Payload ID: 2856
  Gene Symbol: CCL5
  Gene Name: chemokine (C-C motif) ligand 5
  Uniprot ID: P13501
  ENST ID: ENST00000613606
  CDS Start-End: 204-479

SEQ ID NO: 117137 - DNA, 1244 bp, Homo sapiens; identical to SEQ ID NO: 117135
  Payload ID: 2856
  Gene Symbol: CCL5
  Gene Name: chemokine (C-C motif) ligand 5
  ENST ID: ENST00000618639
  CDS Start-End: 83-358

SEQ ID NO: 117138 - DNA, 719 bp, Homo sapiens; identical to SEQ ID NO: 117133
  Payload ID: 2856
  Gene Symbol: CCL5
  Gene Name: chemokine (C-C motif) ligand 5
  ENST ID: ENST00000632752
  CDS Start-End: 1-451

SEQ ID NO: 117139 - DNA, 810 bp, Homo sapiens
  Payload ID: 2857
  Gene Symbol: CCL7
  Gene Name: chemokine (C-C motif) ligand 7
  Uniprot ID: P80098
  ENST ID: ENST00000378569
  CDS Start-End: 71-370
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataaca

SEQ ID NO: 117140 - DNA, 696 bp, Homo sapiens
  Payload ID: 2857
  Gene Symbol: CCL7
  Gene Name: chemokine (C-C motif) ligand 7
  ENST ID: ENST00000394627
  CDS Start-End: 68-313
agaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctc

SEQ ID NO: 117141 - DNA, 687 bp, Homo sapiens
  Payload ID: 2857
  Gene Symbol: CCL7
  Gene Name: chemokine (C-C motif) ligand 7
  ENST ID: ENST00000394630
  CDS Start-End: 68-211
agaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataa

SEQ ID NO: 117142 - DNA, 1261 bp, Homo sapiens
  Payload ID: 2858
  Gene Symbol: CCL8
  Gene Name: chemokine (C-C motif) ligand 8
  Uniprot ID: P80075
  ENST ID: ENST00000394620
  CDS Start-End: 467-766
gtgactctagtgtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaaaatgcaaaatcctggtgatgtgttttttgtttttgttttcctgtgagctcaactaagttcacggcaaaatgtcattgttctccctcctacctgtctgtagtgttgtggggtcctcccatggatcatcaaggtgaaacactttggtattctttggcaatcagtgctcctgtaagtcaaatgtgtgctttgtactgctgttgttgaaattgatgttactgtatataactatggaattttgaaaaaaaatttcaaaaagaaaaaaatatatataatttaaaacta

SEQ ID NO: 117143 - DNA, 2731 bp, Homo sapiens
  Payload ID: 2859
  Gene Symbol: CCR1
  Gene Name: chemokine (C-C motif) receptor 1
  Uniprot ID: P32246
  ENST ID: ENST00000296140
  CDS Start-End: 127-1194
atcacacaggaagctgagtacttcctacttggtcaggatcttgaaacttgaattcataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcatt

SEQ ID NO: 117144 - DNA, 1773 bp, Homo sapiens
  Payload ID: 2860
  Gene Symbol: CCR10
  Gene Name: chemokine (C-C motif) receptor 10
  Uniprot ID: P46092
  ENST ID: ENST00000332438
  CDS Start-End: 21-1109
agaaacctgtgtagccagagatggggacggaggccacagagcaggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctgcccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaatgagatgcaacccaacaactgttactatttttgagtcaccgacttggaagtgatttgtggcggggcagaaccggtgggttaacaccccgcccccgccccaccccccgccctgccccgcgcttggctctctgagtggaagacgctgagggcctgggtgggggtggggggctgctgagtctgctaaagctctagccactgacaccccctccaccgtcacctggcctcagccaacagaggtgaggtgggaaagctgccaggcaaggaggggcggtggttcctcttgcaatactgtaaggaagagctttctaacaaccagagcgctctccagtaatggctgccttagcaaatactgagttcccgctattggaatgttcagactgtcggggacgctgtgggcctttgcgtggtgtggggggagggggaggggcaggggattcccgtttttggtgggcgtttggatttcataaccactttacaatcccttcctagtgtctgtgatggaaagaaaaaatgaaaaaatgaattgtaaaa

SEQ ID NO: 117145 - DNA, 994 bp, Homo sapiens
  Payload ID: 2860
  Gene Symbol: CCR10
  Gene Name: chemokine (C-C motif) receptor 10
  ENST ID: ENST00000591568
  CDS Start-End: 745-994
agcctggcgaatctcggcgcagtaaggagactgtagtaggaggaggcgcccagggagcgtgcatacaggggacccaccagctcctcgtcgcagccgtctagggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctca

SEQ ID NO: 117146 - DNA, 1942 bp, Homo sapiens
  Payload ID: 2860
  Gene Symbol: CCR10
  Gene Name: chemokine (C-C motif) receptor 10
  ENST ID: ENST00000591765
  CDS Start-End: 1387-1809
agagctgcaatgcggagcgcgggggagaggcaggaaaagatgagagccagcgggcgcgcgccggccgggaaggacccgcgaccacccagccgcaatgcggttcggggccgccctgcaggctctggactcctgggcccaaccccacctgcctccaagcccaacactcacagtagccccagccctcggctcctgagaccgcggcgagcaggatgcagaagagccggagatgcatcatgcagggctgacggtcccggcagccgcctccctgtgaacggctccggctagggctcgagttctggcttgggctccaagctctcctcctggggtttgcagcagaccgctctctcctccttacccacccttccctccctctctcctttcgcccccaagcgctctgtctctcctctctcttttctctctctctctctctggttcctggtcctccgctcttctctctctatcctctcctttccaccctctttcctctcacctccccccttccccagcctctgtctcctggcacgcgccggtttcccggaccccgcgcaagcgcgtgcctcagccctgctgcgaaagggcgggggtagagagcctctcgccaccgggaaaaccccaagtaacccgaggctgcccgggactagggccacaggagtgaggacagggaacctagggccagaagcatcctgaaaatttcaagaaaagggaggtggtttgggggaggggtgcctggaaatggaatgaagggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctgcccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaa

SEQ ID NO: 117147 - DNA, 2671 bp, Homo sapiens
  Payload ID: 2861
  Gene Symbol: CCR2
  Gene Name: chemokine (C-C motif) receptor 2
  Uniprot ID: P41597
  ENST ID: ENST00000292301
  CDS Start-End: 486-1610
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttg

SEQ ID NO: 117148 - DNA, 2232 bp, Homo sapiens
  Payload ID: 2861
  Gene Symbol: CCR2
  Gene Name: chemokine (C-C motif) receptor 2
  Uniprot ID: P41597
  ENST ID: ENST00000400888
  CDS Start-End: 40-1164
ggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaag

SEQ ID NO: 117149 - DNA, 563 bp, Homo sapiens
  Payload ID: 2861
  Gene Symbol: CCR2
  Gene Name: chemokine (C-C motif) receptor 2
  ENST ID: ENST00000421659
  CDS Start-End: 199-563
agttgctgagaagcctgacataccaggactgcctgagacaagccacaagctgcttctccagatttcaagaatctggctcagtgatatgaaatacaagacttgtgaaaagtgtcaattgcaagagaaatggaaggataaagtatacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacat

SEQ ID NO: 117150 - DNA, 2386 bp, Homo sapiens
  Payload ID: 2861
  Gene Symbol: CCR2
  Gene Name: chemokine (C-C motif) receptor 2
  Uniprot ID: P41597
  ENST ID: ENST00000445132
  CDS Start-End: 496-1578
accaataccctttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatata

SEQ ID NO: 117151 - DNA, 2000 bp, Homo sapiens
  Payload ID: 2862
  Gene Symbol: CCR3
  Gene Name: chemokine (C-C motif) receptor 3
  Uniprot ID: P51677
  ENST ID: ENST00000357422
  CDS Start-End: 544-1611
tgctgggcgaatccctttcttgtctggttcatttggaccctccaaagcccacaggctggaacggctgagtcatccaaacaaaaaaggtggcagcccatccctcccccaggagctctaccctgtctcaagtaggtgctaccctgttgctggtggctggctggaattccaagccagttgatcttatcctgtgaggtcccttggaagtggggcccacagactgacgctgctctgcttcctggattcagccctcttcctaaggagctcatggaccctggccgtcatcaggttcaacctcatattcaactgctgggccttgtcttctggccacacactctctccaaatcagcgatggtggggaactgaggagccagaggccattgtggaagaactccaagaaaacaatctccaggttatcacatctaaagcctgagcaagatttgaggctgggaagaggtggatcccagaattggaagaaggagtggtgacgcctaagctatcactggacatatcaaggacttcactaaattagcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataa

SEQ ID NO: 117152 - DNA, 1581 bp, Homo sapiens
  Payload ID: 2862
  Gene Symbol: CCR3
  Gene Name: chemokine (C-C motif) receptor 3
  Uniprot ID: P51677
  ENST ID: ENST00000395940
  CDS Start-End: 120-1187
atatcaaggacttcactaaattagcaggtaccactggtcttcttgtgcttatccgggcaagaacttatcgaaatacaatagaagtttttacttagaagagattttcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaa

SEQ ID NO: 117153 - DNA, 1201 bp, Homo sapiens
  Payload ID: 2862
  Gene Symbol: CCR3
  Gene Name: chemokine (C-C motif) receptor 3
  Uniprot ID: P51677
  ENST ID: ENST00000395942
  CDS Start-End: 32-1099
tttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagt

SEQ ID NO: 117154 - DNA, 400 bp, Homo sapiens
  Payload ID: 2862
  Gene Symbol: CCR3
  Gene Name: chemokine (C-C motif) receptor 3
  ENST ID: ENST00000452454
  CDS Start-End: 160-400
accactggtcttcttgtgcttatccgggcaagaacttatcgaaatacaatagaagtttttacttagaagagattttcagctgctgtggattggattatgccatttggaataagaatgctgttaagagcacacaagccaggttcctcaaggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacc

SEQ ID NO: 117155 - DNA, 212 bp, Homo sapiens
  Payload ID: 2862
  Gene Symbol: CCR3
  Gene Name: chemokine (C-C motif) receptor 3
  ENST ID: ENST00000457243
  CDS Start-End: 150-212
ccactggtcttcttgtgcttatccgggcaagaacttatcgaaatacaatagaagtttttacttagaagagattttcagctgctgtggattggattatgccatttggaataagaatgctgttaagagcacacaagccagggagaagtgaaatgacaacctcactagatacagttgagacctttggtaccacatcctactatgatgacgtgggc

SEQ ID NO: 117156 - DNA, 1786 bp, Homo sapiens
  Payload ID: 2862
  Gene Symbol: CCR3
  Gene Name: chemokine (C-C motif) receptor 3
  Uniprot ID: P51677
  ENST ID: ENST00000545097
  CDS Start-End: 176-1306
ctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagctgctgtggattggattatgccatttggaataagaatgctgttaagagcacacaagccaggttcctcaaggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagcttgttttttcagtgtgaataaataatcgtaagcaaca

SEQ ID NO: 117157 - DNA, 3095 bp, Homo sapiens
  Payload ID: 2863
  Gene Symbol: CCR4
  Gene Name: chemokine (C-C motif) receptor 4
  Uniprot ID: P51679
  ENST ID: ENST00000330953
  CDS Start-End: 169-1251
gctcacaggaagccacgcacccttgaaaggcaccgggtccttcttagcatcgtgcttcctgagcaagcctggcattgcctcacagaccttcctcagagccgctttcagaaaagcaagctgcttctggttgggcccagacctgccttgaggagcctgtagagttaaaaaatgaaccccacggatatagcagacaccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcaattgtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatctccatgatgctctgtagaaaaatgaaatggtgaaatgcagagtcaatgaactttccacattcagagcttacttaaaattgtattttagtaagagattcctgagccagtgtcaggaggaaggcttacacccacagtggaaagacagcttctcatcctgcaggcagctttttctctcccactagacaagtccagcctggcaagggttcacctgggctgaggcatccttcctcacaccaggcttgcctgcaggcatgagtcagtctgatgagaactctgagcagtgcttgaatgaagttgtaggtaatattgcaaggcaaagactattcccttctaacctgaactgatgggtttctccagagggaattgcagagtactggctgatggagtaaatcgctaccttttgctgtggcaaatgggccctctaattaatttcttgcttttgcggaacaatatagataactgtttttctaataacatatctcaggcaaagtatattccattgagccagatgtatgaagaaacaattagcgaagtgatgaaaccagatctcaattatttattgtaaaggattatctgttaattgaaaccaaactttttatactgatataagggtaaggatatgaagacattagccaaggtctgctttccaaacgtgaactacaaggcattcaaaatccaaacatatttatgaaaattcaaacacagtttctcacttgtttgtggacatgttttgttctaattttaacagaggaatattaaaaaattttaaataggctgggcacggtggcctgtaatcccagcactgtgggaggccaaggtgggcggatcacctgaggtcaggagttcgagaccagcctggccaacatggagaaaccctgtctctactaaaaaatacaaaattagccaggtgtggtggcgcatgcctgtaatcccagctactcaggaggctgaggctggagaataacttgaatccgggaggtggaggttgcggtgagccgagatcgcgccattgtactccaacctgggcaaaaagagcgaaactctgtctcaaaaaaaaaaaaaaaaaattaaataatacataggccaagaatacatttatttgaggtcatttacttgtttttttttttttttttttttttgagatggaatcttgctctgtcacccagtctggagtgcagtggcgcgatctcggctcactgcaagctctgcctcacgggttcgcaccattctcctgcctcagcctcccaagtaggtgggactacaggcacctgcccccatgcctggctaattttttgtattttcagtagagatggggtttcaccatgttagcaaggatggttttaatctcctgacctcgtgatccacccgcctcggcctcccaaagtgctgggattacaggtgtgagccatcacgcccggccacttgtttattttttattttattttattttatttttgagatggagtctcactctgtcacccaagctggagtgcagtggcactcggttcactgcaaagtctgcctcccaggttcaagcgattctcctgcctcagcttctcaagcagctgggattagaggtgtgcaccactacgccaggctaatttttgtatttttagtagagatggggtttcaccatattggccaggctagtcttgaactcctgacctcaggtgatctgcctgcttcagcctcccaaagtgctgggattacaggcgtgagccacctcgcccagccaaggtcttttacttgtttataaacagtctcttcataattaaaattaaggattaataaagtatgacaatacctccttaatcattttgaagtgcctgctatcaattgaaataaaaacaatcaactaaaa

SEQ ID NO: 117158 - DNA, 3450 bp, Homo sapiens
  Payload ID: 2864
  Gene Symbol: CCR5
  Gene Name: chemokine (C-C motif) receptor 5 (gene/pseudogene)
  Uniprot ID: P51681
  ENST ID: ENST00000292303
  CDS Start-End: 147-1205
acttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 117159 - DNA, 1292 bp, Homo sapiens
  Payload ID: 2864
  Gene Symbol: CCR5
  Gene Name: chemokine (C-C motif) receptor 5 (gene/pseudogene)
  Uniprot ID: P51681
  ENST ID: ENST00000445772
  CDS Start-End: 234-1292
ccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtga

SEQ ID NO: 117160 - DNA, 2980 bp, Homo sapiens
  Payload ID: 2865
  Gene Symbol: CCR6
  Gene Name: chemokine (C-C motif) receptor 6
  Uniprot ID: P51684
  ENST ID: ENST00000349984
  CDS Start-End: 265-1389
caaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaa

SEQ ID NO: 117161 - DNA, 4018 bp, Homo sapiens
  Payload ID: 2865
  Gene Symbol: CCR6
  Gene Name: chemokine (C-C motif) receptor 6
  Uniprot ID: P51684
  ENST ID: ENST00000341935
  CDS Start-End: 553-1677
tgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccaacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgt

SEQ ID NO: 117162 - DNA, 3216 bp, Homo sapiens
  Payload ID: 2865
  Gene Symbol: CCR6
  Gene Name: chemokine (C-C motif) receptor 6
  Uniprot ID: P51684
  ENST ID: ENST00000400926
  CDS Start-End: 306-1430
agtgtatgggtgaaggaggcagcagtgtggccggagaggagagctgggctgggagcacaggaaggtccccaggactctgtggtcatcagtaagagagggcccacgtgtatatgctggtgaacagaaatgtcaaccttttcaaagtctgacatttaagagaaaaaactgtggctgttggtttgtggaacagacagctccttctttattgagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccaacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaa

SEQ ID NO: 117163 - DNA, 2173 bp, Homo sapiens
  Payload ID: 2866
  Gene Symbol: CCR7
  Gene Name: chemokine (C-C motif) receptor 7
  Uniprot ID: P32248
  ENST ID: ENST00000246657
  CDS Start-End: 64-1200
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaa

SEQ ID NO: 117164 - DNA, 1874 bp, Homo sapiens
  Payload ID: 2866
  Gene Symbol: CCR7
  Gene Name: chemokine (C-C motif) receptor 7
  ENST ID: ENST00000579344
  CDS Start-End: 344-1462
ctctagatgagtcagtggagggcgggtggagcgttgaaccgtgaagagtgtggttgggcgtaaacgtggacttaaactcaggagctaaggggtaattcagtgaaaaaggggaatgagcggtggggagctctgttgcaacagggtccaatcgcagcaggactacaaatgcccgagcgcaggctgggaacgaggggacagcggctgcctgtccccagaatagaaaatgcagctaggaagccctctttgagtggacagcggaggactggactgccaggccaagcatcaggggcttcatcctcagggccggttagagcccctgaggatttaggaggaagggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctctt

SEQ ID NO: 117165 - DNA, 787 bp, Homo sapiens
  Payload ID: 2866
  Gene Symbol: CCR7
  Gene Name: chemokine (C-C motif) receptor 7
  ENST ID: ENST00000578085
  CDS Start-End: 190-787
gcgaggccgggcacagccttcctgtgtggttttaccgcccagagagcgtcatggacctgggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatca

SEQ ID NO: 117166 - DNA, 1253 bp, Homo sapiens
  Payload ID: 2867
  Gene Symbol: CCR8
  Gene Name: chemokine (C-C motif) receptor 8
  Uniprot ID: P51685
  ENST ID: ENST00000326306
  CDS Start-End: 139-1206
tttgtagtgggaggatacctccagagaggctgctgctcattgagctgcactcacatgaggatacagactttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgc

SEQ ID NO: 117167 - DNA, 1078 bp, Homo sapiens
  Payload ID: 2867
  Gene Symbol: CCR8
  Gene Name: chemokine (C-C motif) receptor 8
  ENST ID: ENST00000414803
  CDS Start-End: 72-428
ctttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatgacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgctagtagcagtgagcaaaggtgtgggtgtgaaaggtttccaaaaaaagttcagcatgaaggatgcc

SEQ ID NO: 117168 - DNA, 2653 bp, Homo sapiens
  Payload ID: 2868
  Gene Symbol: CCR9
  Gene Name: chemokine (C-C motif) receptor 9
  Uniprot ID: P51686
  ENST ID: ENST00000355983
  CDS Start-End: 303-1376
gcttcctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacatctcctccaggccccgctccagatcaccttccctcgctggcccaggaatccatctccttccaggaccttagcccaggactaacacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacatt

SEQ ID NO: 117169 - DNA, 2569 bp, Homo sapiens
  Payload ID: 2868
  Gene Symbol: CCR9
  Gene Name: chemokine (C-C motif) receptor 9
  Uniprot ID: P51686
  ENST ID: ENST00000357632
  CDS Start-End: 181-1290
gcttcctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacattaa

SEQ ID NO: 117170 - DNA, 2512 bp, Homo sapiens
  Payload ID: 2868
  Gene Symbol: CCR9
  Gene Name: chemokine (C-C motif) receptor 9
  Uniprot ID: P51686
  ENST ID: ENST00000395963
  CDS Start-End: 163-1236
ctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacat

SEQ ID NO: 117171 - DNA, 1331 bp, Homo sapiens
  Payload ID: 2868
  Gene Symbol: CCR9
  Gene Name: chemokine (C-C motif) receptor 9
  ENST ID: ENST00000422395
  CDS Start-End: 136-459
cacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacatctcctccaggccccgctccagatcaccttccctcgctggcccaggaatccatctccttccaggaccttagcccaggactaacacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctga

SEQ ID NO: 117172 - DNA, 1593 bp, Homo sapiens
  Payload ID: 2869
  Gene Symbol: CCRL2
  Gene Name: chemokine (C-C motif) receptor-like 2
  Uniprot ID: O00421
  ENST ID: ENST00000357392
  CDS Start-End: 114-1184
gagcatggtttcacttttgcaaacatttatttatacccttcgagagaaaaacgtctcagctgtcacaggaagctgcttcggggggtgagcaaactttttaaaatgcagaaattatgatctacacccgtttcttaaaaggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatcta

SEQ ID NO: 117173 - DNA, 1796 bp, Homo sapiens
  Payload ID: 2869
  Gene Symbol: CCRL2
  Gene Name: chemokine (C-C motif) receptor-like 2
  Uniprot ID: O00421
  ENST ID: ENST00000399036
  CDS Start-End: 353-1387
ctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatcta

SEQ ID NO: 117174 - DNA, 1106 bp, Homo sapiens
  Payload ID: 2869
  Gene Symbol: CCRL2
  Gene Name: chemokine (C-C motif) receptor-like 2
  Uniprot ID: O00421
  ENST ID: ENST00000400880
  CDS Start-End: 72-1106
tttatttatacccttcgagagaaaaacgtctcagctgtcacaggaagctgcttcgggggggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaa

SEQ ID NO: 117175 - DNA, 1642 bp, Homo sapiens
  Payload ID: 2869
  Gene Symbol: CCRL2
  Gene Name: chemokine (C-C motif) receptor-like 2
  Uniprot ID: O00421
  ENST ID: ENST00000400882
  CDS Start-End: 200-1234
ctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatct

SEQ ID NO: 117176 - DNA, 713 bp, Homo sapiens
  Payload ID: 2869
  Gene Symbol: CCRL2
  Gene Name: chemokine (C-C motif) receptor-like 2
  ENST ID: ENST00000433848
  CDS Start-End: 62-713
gtcacaggaagctgcttcggggggcaagtcctgtttctgctaaaagaagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacat

SEQ ID NO: 117177 - DNA, 3321 bp, Homo sapiens
  Payload ID: 2870
  Gene Symbol: CX3CL1
  Gene Name: chemokine (C-X3-C motif) ligand 1
  Uniprot ID: P78423
  ENST ID: ENST00000006053
  CDS Start-End: 112-1305
attataaaaagccacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaatcaa

SEQ ID NO: 117178 - DNA, 3313 bp, Homo sapiens
  Payload ID: 2870
  Gene Symbol: CX3CL1
  Gene Name: chemokine (C-X3-C motif) ligand 1
  ENST ID: ENST00000563383
  CDS Start-End: 93-1304
ctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggaacctctttgaactcaggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgt

SEQ ID NO: 117179 - DNA, 563 bp, Homo sapiens
  Payload ID: 2870
  Gene Symbol: CX3CL1
  Gene Name: chemokine (C-X3-C motif) ligand 1
  ENST ID: ENST00000564948
  CDS Start-End: 45-212
gccgcctgcctggcccccgccgggactcttgcccaccctcagccatggctccgatatctctgtcgtggctgctccgcttggccaccttctgccatctgactgtcctgctggctgcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaa

SEQ ID NO: 117180 - DNA, 5796 bp, Homo sapiens
  Payload ID: 2870
  Gene Symbol: CX3CL1
  Gene Name: chemokine (C-X3-C motif) ligand 1
  ENST ID: ENST00000565912
  CDS Start-End: 2707-3786
acaggctccccaggtcagttaaacaatcttcctggcagaaccaagaactgagccgggccaggaccattcagggaccgtggcagagggtggggactttggagacaggatgactctgtggctctttaaagccctggaggtgggcaatggcttttcccatcttggatttggggagcacagaatggaccttctttcctatccattgggcagcctcccttgcctcctcctgtctctggtcactcaggggcaccgtattttctggggcttcccaaagaagacacctgcaggccattttaggggactgccacctggctccactcaatagggcctggggaggctgcaggtgagtcagtctgaggttccattgcagaaggagggtggccagcccacacagtgacttttatatcctggttactcagagagaaaggacagccctgtgacctggggagcccctcctgcacacagcccccaaccccctgaagctactagtgcttctccttgatgactcaacccagacctgccggccctaaaccaccttcccacaaagcagggtgggccaaagctaagggggagcgatggagagaggaagcagcagactctacaaagtctctctgtgtgtgcaagcgtgcatgtgcctgtatttgggaaagtggtgtatgtttgcatggccacatatatgtaaatatttatgcatgagcagttcgtgttctggtggagcccagggatgccctgggggtttcccaggctctgaagggctagataagatcagcttgctctcttgactgccctggtctccagatgtttgcaaaaccctctggggtcttgcttttgctgcatataaccttgactcagatctgaaactcaagctcttccttgttttttatactcatcctccttgagctcaagctaagcagaagaaaatttgctggagattatagaggaagagaaaaggtggaaattcaatgtaaacaacttcaaatgtttatatcaaatagttgggtttatttgtcctgtcccggggtttctctctggttccacgtgacactcagctactgcctgccccttccgccccactctgcccccaccttattcataccgtccatctccaaccctcctccttactcttcttgctccaggaatttcaaatgcctcttccctcctaggcaggatgactcagtacctttcagcaactgctctcgggctcattctggctctcagcagcagaacaaaggatcatctattcagcagaccccaccttccttagaaagcagttgtacttatatattttttaaaaagtttattgctgggcatagtggcttacatctgtaatcccagctattccggaggttgaagtgggagaatcacttgcggtcggggttcaagaccagcctgggcaacatagcaagaccctgtctcttaaaaaaattagccaggcatggtagcaggcacctgtagtcccagctacttgggaggctgaggcaagagatctcttttttttttttcttttttttttgagacggagtcttgttctgtcacccaggctttagtgcagtggtatgatctcagctcactgcaacctctgcctcccggattcaagcaattctcctgtctcagcttcccgagtagctgggactaaaggtgcacaccatcatgccaggctaatttgtgtatttgtagtagagacaaggtttcaccatattgatcaggctggtctcaaactcctgacctcagatgatctatctgtctcggcctcccaaagtgctgggattacaggtgtgagccaccgcacccggccaggaggatttcttgagcccaggattttgaggttgccgtgagctaggattataccactgcactccagcctgggcaacagaacaagaccctatctcttaaaaaaaaatggcagcgggaagaaataaggcagaggtgaggggataggcaaggccacaggcccggtggggactagagcaggagaacctgctccatcacttgctggctgtgtgaccttagcaggtccctgtcactctcagattcatcccccctgctgcacaatggaccacttaattttaaaaattaactcgggcatggtggctcacgcctgtaatcccagcactttgggaggccaaggagggcagatcacctgaggtcgggagtctgagaccagcctgaccaacatggagaaaccccgtctctactaaaaatacaaaattagccaggagtcgtggcacatgcctgtaatcccagctattcgggagtctgaggcaggagaatcgcttgaatctgggaggccgaggttgcggtgagccgagatcatgccattgcactccagcctgggcaacaagagcaagactccaactcaaaaaaaaaaaaattaaactcttaatatgtgccaggcaaaaagaactctataaataagaattcacgtttcttattcttacaacaagactatgaggtagatgctatttttgttcctattttacaggtggggaaactgaggcatagagaagtttggcaggggagggaggctgagtcaaaggccttgaaggccagggtgtacaggggatcagttttggcttgggtggtgtggccgggacaatctggcacggggttgggaagccagatgcccacagacatccctgctgaccaggaacctctttgaactcaggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtg

SEQ ID NO: 117181 - DNA, 3151 bp, Homo sapiens
  Payload ID: 2871
  Gene Symbol: CX3CR1
  Gene Name: chemokine (C-X3-C motif) receptor 1
  Uniprot ID: P49238
  ENST ID: ENST00000358309
  CDS Start-End: 41-1204
ggggcgggccgtgcttaccaggccgtggacttaaaccaggatgagagaacccctggaggcgtttaagttggcagacttggatttcaggaagagctctctggcttctgggtggagaatggccagtggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 117182 - DNA, 3106 bp, Homo sapiens
  Payload ID: 2871
  Gene Symbol: CX3CR1
  Gene Name: chemokine (C-X3-C motif) receptor 1
  Uniprot ID: P49238
  ENST ID: ENST00000399220
  CDS Start-End: 91-1158
aatactcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcca

SEQ ID NO: 117183 - DNA, 699 bp, Homo sapiens
  Payload ID: 2871
  Gene Symbol: CX3CR1
  Gene Name: chemokine (C-X3-C motif) receptor 1
  ENST ID: ENST00000435290
  CDS Start-End: 201-699
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgt

SEQ ID NO: 117184 - DNA, 559 bp, Homo sapiens
  Payload ID: 2871
  Gene Symbol: CX3CR1
  Gene Name: chemokine (C-X3-C motif) receptor 1
  ENST ID: ENST00000412814
  CDS Start-End: 241-559
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccg

SEQ ID NO: 117185 - DNA, 3255 bp, Homo sapiens
  Payload ID: 2871
  Gene Symbol: CX3CR1
  Gene Name: chemokine (C-X3-C motif) receptor 1
  Uniprot ID: P49238
  ENST ID: ENST00000541347
  CDS Start-End: 241-1308
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 117186 - DNA, 3215 bp, Homo sapiens
  Payload ID: 2871
  Gene Symbol: CX3CR1
  Gene Name: chemokine (C-X3-C motif) receptor 1
  Uniprot ID: P49238
  ENST ID: ENST00000542107
  CDS Start-End: 201-1268
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 117187 - DNA, 1097 bp, Homo sapiens
  Payload ID: 2872
  Gene Symbol: CXCL1
  Gene Name: chemokine (C-X-C motif) ligand 1 (melanoma growth stimulating activity, alpha)
  Uniprot ID: P09341
  ENST ID: ENST00000395761
  CDS Start-End: 68-391
gccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaa

SEQ ID NO: 117188 - DNA, 1176 bp, Homo sapiens
  Payload ID: 2873
  Gene Symbol: CXCL10
  Gene Name: chemokine (C-X-C motif) ligand 10
  Uniprot ID: P02778
  ENST ID: ENST00000306602
  CDS Start-End: 67-363
gagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtagaagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaaataaaaatgaggtactctcctggaaatattaagaaagactatctaaatgttgaaagatcaaaaggttaataaagtaattataactaag

SEQ ID NO: 117189 - DNA, 1606 bp, Homo sapiens
  Payload ID: 2874
  Gene Symbol: CXCL11
  Gene Name: chemokine (C-X-C motif) ligand 11
  Uniprot ID: O14625
  ENST ID: ENST00000306621
  CDS Start-End: 211-495
agagaacaaaacagaaactcttggaagcaggaaaggtgcatgactcaaagagggaaattcctgtgccataaaaggattgctggtgtataaaatgctctatatatgccaattatcaatttcctttcatgttcagcatttctactccttccaagaagagcagcaaagctgaagtagcagcagcagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagagcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgcattatacattcatgcatttctaggctagagaaccttctagatttgatgcttacaactattctgttgtgactatgagaacatttctgtctctagaagtcatctgtctgtattgatctttatgctatattactatctgtggttacggtggagacattgacattattactggagtcaagcccttataagtcaaaagcatctatgtgtcgtaaaacattcctcaaacattttttcatgcaaatacacacttctttccccaaacatcatgtagcacatcaatatgtagggagacattcttatgcatcatttggtttgttttataaccaattcattaaatgtaattcataaaatgtactatgaaaaaaattatacgctatgggatactggcaaaagtgcacatatttcataaccaaattagtagcaccagtcttaatttgatgtttttcaacttttattcattgagatgttttgaagcaattaggatatgtgtgtttactgtactttttgttttgatccgtttgtataaatgatagcaatatcttggacacatctgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaa

SEQ ID NO: 117190 - DNA, 767 bp, Homo sapiens
  Payload ID: 2874
  Gene Symbol: CXCL11
  Gene Name: chemokine (C-X-C motif) ligand 11
  Uniprot ID: O14625
  ENST ID: ENST00000503860
  CDS Start-End: 380-664
aagacatcaagacttaaacgaaggaaaggattcaaaagaggagaggaaagtgcattttcatgctagaaaaaccatattatacaaatataaaaaatagggatctctcaggctcaccagatgaggggatgctgtgaaagaaggtaatcttcctcatgtgatgtcagagagtatagagccagaacaagtcacaatcctgaagacacgtctgaccccacacatctacaaagccagcagaaatcaggcagactaacttctacaataaggcagaaagtttgaaatttggaacacacggaaaggacttgcatttctactccttccaagaagagcagcaaagctgaagtagcagcagcagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagagcatctgaaaaacctagaacaagtttaactgtgactactgaaatgacaagaattctacagtaggaaactga

SEQ ID NO: 117191 - DNA, 1857 bp, Homo sapiens
  Payload ID: 2875
  Gene Symbol: CXCL12
  Gene Name: chemokine (C-X-C motif) ligand 12
  Uniprot ID: P48061
  ENST ID: ENST00000343575
  CDS Start-End: 88-357
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggta

SEQ ID NO: 117192 - DNA, 470 bp, Homo sapiens
  Payload ID: 2875
  Gene Symbol: CXCL12
  Gene Name: chemokine (C-X-C motif) ligand 12
  Uniprot ID: P48061
  ENST ID: ENST00000374426
  CDS Start-End: 39-398
cccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaaggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctcc

SEQ ID NO: 117193 - DNA, 3532 bp, Homo sapiens
  Payload ID: 2875
  Gene Symbol: CXCL12
  Gene Name: chemokine (C-X-C motif) ligand 12
  Uniprot ID: P48061
  ENST ID: ENST00000374429
  CDS Start-End: 88-369
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgta

SEQ ID NO: 117194 - DNA, 665 bp, Homo sapiens
  Payload ID: 2875
  Gene Symbol: CXCL12
  Gene Name: chemokine (C-X-C motif) ligand 12
  Uniprot ID: P48061
  ENST ID: ENST00000395793
  CDS Start-End: 88-399
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactct

SEQ ID NO: 117195 - DNA, 1052 bp, Homo sapiens
  Payload ID: 2875
  Gene Symbol: CXCL12
  Gene Name: chemokine (C-X-C motif) ligand 12
  Uniprot ID: P48061
  ENST ID: ENST00000395794
  CDS Start-End: 45-467
ccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaacctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgca

SEQ ID NO: 117196 - DNA, 404 bp, Homo sapiens
  Payload ID: 2875
  Gene Symbol: CXCL12
  Gene Name: chemokine (C-X-C motif) ligand 12
  Uniprot ID: P48061
  ENST ID: ENST00000395795
  CDS Start-End: 93-404
gccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctag

SEQ ID NO: 117197 - DNA, 1203 bp, Homo sapiens
  Payload ID: 2876
  Gene Symbol: CXCL13
  Gene Name: chemokine (C-X-C motif) ligand 13
  Uniprot ID: O43927
  ENST ID: ENST00000286758
  CDS Start-End: 79-408
gagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaa

SEQ ID NO: 117198 - DNA, 1971 bp, Homo sapiens
  Payload ID: 2877
  Gene Symbol: CXCL14
  Gene Name: chemokine (C-X-C motif) ligand 14
  Uniprot ID: O95715
  ENST ID: ENST00000337225
  CDS Start-End: 466-801
aatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacc

SEQ ID NO: 117199 - DNA, 1760 bp, Homo sapiens
  Payload ID: 2877
  Gene Symbol: CXCL14
  Gene Name: chemokine (C-X-C motif) ligand 14
  ENST ID: ENST00000512158
  CDS Start-End: 287-586
gcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaa

SEQ ID NO: 117200 - DNA, 2222 bp, Homo sapiens
  Payload ID: 2878
  Gene Symbol: CXCL16
  Gene Name: chemokine (C-X-C motif) ligand 16
  Uniprot ID: Q9H2A7
  ENST ID: ENST00000293778
  CDS Start-End: 424-1245
cccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcagcgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaatgaagaa

SEQ ID NO: 117201 - DNA, 1668 bp, Homo sapiens
  Payload ID: 2878
  Gene Symbol: CXCL16
  Gene Name: chemokine (C-X-C motif) ligand 16
  Uniprot ID: Q9H2A7
  ENST ID: ENST00000574412
  CDS Start-End: 527-1348
tccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactata

SEQ ID NO: 117202 - DNA, 589 bp, Homo sapiens
  Payload ID: 2878
  Gene Symbol: CXCL16
  Gene Name: chemokine (C-X-C motif) ligand 16
  ENST ID: ENST00000573123
  CDS Start-End: 309-589
aaagccagccagccgcctggggttggggacagaggcccggggacgcctggctccgggcgggattatggatgttgtcgggggcgtgatgatgtgtgggttgagcctggcgctctgaccctgggtccaccgagaggctgtcatggggctgtggattggatgccagggaacagcggagtggggaccctgggcctgggaatgggtgccgaccacctccgtcccgcgcaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccac

SEQ ID NO: 117203 - DNA, 748 bp, Homo sapiens
  Payload ID: 2879
  Gene Symbol: CXCL17
  Gene Name: chemokine (C-X-C motif) ligand 17
  ENST ID: ENST00000341918
  CDS Start-End: 21-209
cagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagcaatgctgttgttccagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaa

SEQ ID NO: 117204 - DNA, 1172 bp, Homo sapiens
  Payload ID: 2879
  Gene Symbol: CXCL17
  Gene Name: chemokine (C-X-C motif) ligand 17
  Uniprot ID: Q6UXB2
  ENST ID: ENST00000601181
  CDS Start-End: 217-576
gattcccataaagcacatggtctaatctgttacgtaacagcaagacagcgtcacctcacctgttctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattctacacatacttatccccaccaagaccctcactctgtctccattggcctacttgttcatctttcactcattcgacaaatctttctgaggtaagagcgaggtgggacaaaaaaaaaaaagcataccaatgaaccagacacggtcttattaaagataatataggttt

SEQ ID NO: 117205 - DNA, 1218 bp, Homo sapiens
  Payload ID: 2880
  Gene Symbol: CXCL2
  Gene Name: chemokine (C-X-C motif) ligand 2
  Uniprot ID: P19875
  ENST ID: ENST00000508487
  CDS Start-End: 174-497
cgggatcgatctggagctccgggaatttccctggcccgggactccgggctttccagccccaaccatgcataaaaggggttcgccgttctcggagagccacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaatataaaa

SEQ ID NO: 117206 - DNA, 1075 bp, Homo sapiens
  Payload ID: 2881
  Gene Symbol: CXCL3
  Gene Name: chemokine (C-X-C motif) ligand 3
  Uniprot ID: P19876
  ENST ID: ENST00000296026
  CDS Start-End: 79-402
acacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaaaaa

SEQ ID NO: 117207 - DNA, 2538 bp, Homo sapiens
  Payload ID: 2882
  Gene Symbol: CXCL5
  Gene Name: chemokine (C-X-C motif) ligand 5
  Uniprot ID: P42830
  ENST ID: ENST00000296027
  CDS Start-End: 199-543
ccatgagttcagggaatttccccagcatcccaaagcttgagtttcctgtcagtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcgggagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttca

SEQ ID NO: 117208 - DNA, 1718 bp, Homo sapiens
  Payload ID: 2883
  Gene Symbol: CXCL6
  Gene Name: chemokine (C-X-C motif) ligand 6
  Uniprot ID: P80162
  ENST ID: ENST00000226317
  CDS Start-End: 255-599
aggcagctcctcccagccacccaccccaccaattcccatcctcccgcccccctccaccaaccccttctttccacactgccccctgagttcagggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagacgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatatagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaacca

SEQ ID NO: 117209 - DNA, 557 bp, Homo sapiens
  Payload ID: 2883
  Gene Symbol: CXCL6
  Gene Name: chemokine (C-X-C motif) ligand 6
  ENST ID: ENST00000515050
  CDS Start-End: 112-453
gaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacaggtatttgtccctttgatctttgtggtgttttaatatcttctatggaaagcatatacttcacaatgtccttattctctctgtaggatttagactatgcttagaattataaggttgttaaga

SEQ ID NO: 117210 - DNA, 1705 bp, Homo sapiens
  Payload ID: 2884
  Gene Symbol: CXCL8
  Gene Name: chemokine (C-X-C motif) ligand 8
  Uniprot ID: P10145
  ENST ID: ENST00000307407
  CDS Start-End: 154-453
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 117211 - DNA, 700 bp, Homo sapiens
  Payload ID: 2884
  Gene Symbol: CXCL8
  Gene Name: chemokine (C-X-C motif) ligand 8
  ENST ID: ENST00000401931
  CDS Start-End: 119-406
aaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagaggtaagttatatattttttaatttaaatttttcatttatcctgagacatataatccaaagtcagcctataaatttctttctgttgctaaaaatcgtcattaggtatctgcctttttggttaaaaaaaaaaggaatagcatcaatagtgagtttgttgtactcatgaccagaaagaccatacatagtttgcccaggaaattctgggtttaagcttgtgtcctatactcttagtaaagttctttgtcactcccagtagtgtcctattttagatgataatttctttgatctccctatttata

SEQ ID NO: 117212 - DNA, 2740 bp, Homo sapiens
  Payload ID: 2885
  Gene Symbol: CXCL9
  Gene Name: chemokine (C-X-C motif) ligand 9
  Uniprot ID: Q07325
  ENST ID: ENST00000264888
  CDS Start-End: 40-417
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcagaaaacagatcttgattttttttctcttgaatgtacccttcaactgttgaatgtttaatagtaaatcttatatgtccttatttactttttagctttctctcaaataaagtgtaacactagttgagataacacatgaaagctctttaaagggtcgatcgggaacaggaaaaaaaacctatggaaaatatgacaacac

SEQ ID NO: 117213 - DNA, 2488 bp, Homo sapiens
  Payload ID: 2886
  Gene Symbol: CXCR1
  Gene Name: chemokine (C-X-C motif) receptor 1
  Uniprot ID: P25024
  ENST ID: ENST00000295683
  CDS Start-End: 122-1174
tttattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaa

SEQ ID NO: 117214 - DNA, 2879 bp, Homo sapiens
  Payload ID: 2887
  Gene Symbol: CXCR2
  Gene Name: chemokine (C-X-C motif) receptor 2
  Uniprot ID: P25025
  ENST ID: ENST00000318507
  CDS Start-End: 428-1510
aggaagtgcaggttcaaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttata

SEQ ID NO: 117215 - DNA, 585 bp, Homo sapiens
  Payload ID: 2887
  Gene Symbol: CXCR2
  Gene Name: chemokine (C-X-C motif) receptor 2
  ENST ID: ENST00000415392
  CDS Start-End: 171-585
gcagtgtctttgttgagcagcagaggggagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcct

SEQ ID NO: 117216 - DNA, 621 bp, Homo sapiens
  Payload ID: 2887
  Gene Symbol: CXCR2
  Gene Name: chemokine (C-X-C motif) receptor 2
  ENST ID: ENST00000428565
  CDS Start-End: 105-621
gttctcaccaccacctccctttcataggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgt

SEQ ID NO: 117217 - DNA, 262 bp, Homo sapiens
  Payload ID: 2887
  Gene Symbol: CXCR2
  Gene Name: chemokine (C-X-C motif) receptor 2
  ENST ID: ENST00000449014
  CDS Start-End: 218-262
ggggaggtgaggaagtggagagagcagctgtggtggctgaagggtgctaggacagagggagcatgataaagccataactctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctgg

SEQ ID NO: 117218 - DNA, 813 bp, Homo sapiens
  Payload ID: 2887
  Gene Symbol: CXCR2
  Gene Name: chemokine (C-X-C motif) receptor 2
  ENST ID: ENST00000453237
  CDS Start-End: 212-813
taagcagtggtgatagctgagaatatgcagccgttttctccttcctgggtacagtgctattctgcctagagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatggg

SEQ ID NO: 117219 - DNA, 597 bp, Homo sapiens
  Payload ID: 2887
  Gene Symbol: CXCR2
  Gene Name: chemokine (C-X-C motif) receptor 2
  ENST ID: ENST00000454148
  CDS Start-End: 191-597
aaaacattcagagacagaaggtggatagacaaatctccaccttcagactgctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgct

SEQ ID NO: 117220 - DNA, 223 bp, Homo sapiens
  Payload ID: 2887
  Gene Symbol: CXCR2
  Gene Name: chemokine (C-X-C motif) receptor 2
  ENST ID: ENST00000418878
  CDS Start-End: 179-223
gacctggttctccttgctgagttctctaccttctgtcctgacttgcatgctctccctctggaacctgaagctgacccataatgcctgggagcatgagctcacccatacacctccagcccacccccagcacagctgagcactggattatccacagtcaggatttaagtttacctcaaaaatggaagattttaacatggagagtgacagctttgaagatttctgg

SEQ ID NO: 117221 - DNA, 1861 bp, Homo sapiens
  Payload ID: 2888
  Gene Symbol: CXCR3
  Gene Name: chemokine (C-X-C motif) receptor 3
  Uniprot ID: P49682
  ENST ID: ENST00000373691
  CDS Start-End: 165-1412
caagcaccaaagcagaggggcaggcagcacaccacccagcagccagagcaccagcccagccatggtccttgaggggtccctgggccgatgggatcacgcagaagaatgcgagagaagcagcctttgagaagggaagtcactatcccagagcccaggctgagcggatggagttgaggaagtacggccctggaagactggcggggacagttataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggacca

SEQ ID NO: 117222 - DNA, 1624 bp, Homo sapiens
  Payload ID: 2888
  Gene Symbol: CXCR3
  Gene Name: chemokine (C-X-C motif) receptor 3
  Uniprot ID: P49682
  ENST ID: ENST00000373693
  CDS Start-End: 69-1175
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggacca

SEQ ID NO: 117223 - DNA, 1682 bp, Homo sapiens
  Payload ID: 2889
  Gene Symbol: CXCR4
  Gene Name: chemokine (C-X-C motif) receptor 4
  Uniprot ID: P61073
  ENST ID: ENST00000241393
  CDS Start-End: 106-1164
cgcggccagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaact

SEQ ID NO: 117224 - DNA, 1895 bp, Homo sapiens
  Payload ID: 2889
  Gene Symbol: CXCR4
  Gene Name: chemokine (C-X-C motif) receptor 4
  Uniprot ID: P61073
  ENST ID: ENST00000409817
  CDS Start-End: 305-1375
ttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 117225 - DNA, 4431 bp, Homo sapiens
  Payload ID: 2890
  Gene Symbol: CXCR5
  Gene Name: chemokine (C-X-C motif) receptor 5
  Uniprot ID: P32302
  ENST ID: ENST00000292174
  CDS Start-End: 177-1295
aaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgtgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagcaataacttgaagaaggggggaagggtttcttttatccttttttttttgtgtgacttctatcaaaacacagaaatacagc

SEQ ID NO: 117226 - DNA, 1962 bp, Homo sapiens
  Payload ID: 2891
  Gene Symbol: CXCR6
  Gene Name: chemokine (C-X-C motif) receptor 6
  Uniprot ID: O00574
  ENST ID: ENST00000304552
  CDS Start-End: 91-1119
gaagtagaggcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 117227 - DNA, 2805 bp, Homo sapiens
  Payload ID: 2891
  Gene Symbol: CXCR6
  Gene Name: chemokine (C-X-C motif) receptor 6
  Uniprot ID: O00574
  ENST ID: ENST00000458629
  CDS Start-End: 1464-2492
atttttattaagcagtcttagcccaaaggcagcatccttccttgctagagagaaagggcactttggtccctggaaagacagaggcaagcagcagcatcggagacactgctcccagtcaggactcaaagtcagcgacagaagtgtttctgagtggattaggaaaggtaacctcatcgtttatatgcacttgtctggtcaggcaatattttgactttgctggcagagattctgtccaaacacctgctcttcttcatacatcttctagaggtgctggccagacatggctccaggtcactggaaatgagctgctgcatgttgagtatctgcagtcctgtagcaagggcagacttggcactcatgggctgatgttgccgcagctgcccctgctcccacaccacaggttacatgatcccttgtcctgtccatggtctttggcagggtcacagggcagagggaagggtcagagagaagtgacatcttgaagggctggtgccctgggtaagaaaggttgcccatctggcatcccatttcaattgggttttctgcttgttaaatgaggcccctaagtcctaacctgccaatcacaggagctaaggcaaggttccgctttggggaaatctaccttttaagagacttcttgttcagaagtcttcaggaaatgaggctctgatggtagaatgccataaactgtgttaactgatgaaggggaaagtttagttgggaagtgaggagaaccacccaatgctttaaccatgaagccagctcagccaaagtgctgggcagtcgtgggcttttctatgctttgtttccccattagtagcctttgaaaatctatgcaattgaggggaagtaaaggcaggaaggactacctacccaggcagagcagtcttgccatccccaaacacctgtggtctccaggagtctccttgataggagagccccctggtaggggcacttgctttagctttcacaatttattaggaaatggggctcaggatgggtgggcaactgtggtgaggcagggggagatgaaaacaggcatgttccattgatgagctcatattatcagtgggctcaaccatccatcatcagtgttgctcttccaaacagcactgtgcccacctggcagcaaagcgacttttggtttcaaaataattgagcacaggattttatggaatgtgcttaggggtcagttatgagttgtctcccagatgggtgagatcctgagaattttcaggctaatggagagtcctcatcctgtctgagcaatttcccctcagaattggttatcttcaatatactggactgtgctgtttctacacatcccagtgggtgggtttagaagatgactatttgccccctaaatgtggtcaatgggatagcaggaagacaaagaatgccatcctcagccccaaatataattcctgggttctgactcacaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactgggg

SEQ ID NO: 117228 - DNA, 2242 bp, Homo sapiens
  Payload ID: 2891
  Gene Symbol: CXCR6
  Gene Name: chemokine (C-X-C motif) receptor 6
  Uniprot ID: O00574
  ENST ID: ENST00000438735
  CDS Start-End: 387-1415
gtcaacccctgtacgcggtttccttctcctgctctcctgcttatagaacaattgttcctccagaacaattcctctcagccatagtggctctgctcccaccagatgatctctcagctcatcctggtgacttgcaggggtacaggtctgccggctatgttgcccaggctggcctcaaactcctggcttcaatgatcctctcatcttagcctcttgagtactgggactataagtgcccactgccacgcctggctggttaggctacttttctgtggatcacagcccatcatccaccaatgccttgccaacaactgtaaatgtctcatccctgaatcctggaactgataacagctctgccaggtcttcaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactg

SEQ ID NO: 117229 - DNA, 1184 bp, Homo sapiens
  Payload ID: 2891
  Gene Symbol: CXCR6
  Gene Name: chemokine (C-X-C motif) receptor 6
  Uniprot ID: O00574
  ENST ID: ENST00000457814
  CDS Start-End: 156-1184
agcatccttccttgctagagagaaagggcactttggtccctggaaagacagaggcaagcagcagcatcggagacactgctcccagtcaggactcaaagtcagcgacagaagtgtttctgagtggattaggaaaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttatag

SEQ ID NO: 117230 - DNA, 669 bp, Homo sapiens
  Payload ID: 2892
  Gene Symbol: CKLF
  Gene Name: chemokine-like factor
  Uniprot ID: Q9UBR5
  ENST ID: ENST00000264001
  CDS Start-End: 150-608
gcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 117231 - DNA, 508 bp, Homo sapiens
  Payload ID: 2892
  Gene Symbol: CKLF
  Gene Name: chemokine-like factor
  Uniprot ID: Q9UBR5
  ENST ID: ENST00000351137
  CDS Start-End: 148-447
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 117232 - DNA, 571 bp, Homo sapiens
  Payload ID: 2892
  Gene Symbol: CKLF
  Gene Name: chemokine-like factor
  Uniprot ID: Q9UBR5
  ENST ID: ENST00000345436
  CDS Start-End: 148-510
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 117233 - DNA, 412 bp, Homo sapiens
  Payload ID: 2892
  Gene Symbol: CKLF
  Gene Name: chemokine-like factor
  Uniprot ID: Q9UBR5
  ENST ID: ENST00000362093
  CDS Start-End: 148-351
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccacata

SEQ ID NO: 117234 - DNA, 628 bp, Homo sapiens
  Payload ID: 2892
  Gene Symbol: CKLF
  Gene Name: chemokine-like factor
  Uniprot ID: Q9UBR5
  ENST ID: ENST00000417030
  CDS Start-End: 135-476
aagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggagggttattttaactcagtataggagctagaggaagagatttccgaagtctgcaccccgcgcagagcactactgtaacttccaagggagcgctgggagcagcgggatcgggttttccggcacccgggcctgggtggcagggaagaatgtgccgggatccgcctca

SEQ ID NO: 117235 - DNA, 546 bp, Homo sapiens
  Payload ID: 2892
  Gene Symbol: CKLF
  Gene Name: chemokine-like factor
  ENST ID: ENST00000534692
  CDS Start-End: 154-255
atgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctgcattgcttggtagtcttcatgtaaggctcagctttattgtgtgtttttaggatattatcaactcactggtaacaacagtattcatgctcatcgtatctgtgttggcactgataccagaaaccacaacattgacagttggtggagggttattttaactcagtataggagctagaggaagagatttccgaagtctgcaccccgcgcagagcactactgtaacttccaagggagcgctgggagcagcgggatcgggttttccggcacccgggcctgggtggcagggaagaatgtgccgggatccgcctcagggatctt

SEQ ID NO: 117236 - DNA, 1133 bp, Homo sapiens
  Payload ID: 2893
  Gene Symbol: CBY1
  Gene Name: chibby homolog 1 (Drosophila)
  Uniprot ID: Q9Y3M2
  ENST ID: ENST00000216029
  CDS Start-End: 135-515
gcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataatctc

SEQ ID NO: 117237 - DNA, 1269 bp, Homo sapiens
  Payload ID: 2893
  Gene Symbol: CBY1
  Gene Name: chibby homolog 1 (Drosophila)
  Uniprot ID: Q9Y3M2
  ENST ID: ENST00000396811
  CDS Start-End: 279-659
gcaggcggcaggaggcgggtgggtcaaggtaactctgggctacagagtccttgctgggggttcggggagcgcttggaccccggcttctgggacgcgtcagaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaa

SEQ ID NO: 117238 - DNA, 744 bp, Homo sapiens
  Payload ID: 2893
  Gene Symbol: CBY1
  Gene Name: chibby homolog 1 (Drosophila)
  ENST ID: ENST00000416285
  CDS Start-End: 442-744
aaggtaactctgggctacagagtccttgctgggggttcggggagcgcttggaccccggcttctgggacgcgtcaggtcgccgtgaagatgattgcatgagatcgtgcgtgtgaacgtttgttgacagctgttacttgagtccgacagccctgggggccgtgcatctgcgtaacatggctacctctgaactccttgggggacacgtatatctttgagaatccgatgaaaaccagagattccgcccttgttttcttagaattaaaaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatg

SEQ ID NO: 117239 - DNA, 615 bp, Homo sapiens
  Payload ID: 2893
  Gene Symbol: CBY1
  Gene Name: chibby homolog 1 (Drosophila)
  ENST ID: ENST00000411557
  CDS Start-End: 432-615
gcgcgtggcgggcaggcggcaggaggcgggtgggtcaaggtaactctgggctacagagtccttgctgggggttcggggagcgcttggaccccggcttctgggacgcgtcaggtcgccgtgaagatgattgcatgagatcgtgcgtgtgaacgtttgttgacagctgttacttgagtccgacagccctgggggccgtgcatctgcgtaacatggctacctctgaactccttgggggacacgtatatctttgagaatccgatgaaaaccagagattccgcccttgttttcttagaattaaaattaccacagactgggtaatttataaagaaaagaagtttatttggctcacagttctggagactgggaagtccaagagcatggtgcaagtatctggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcag

SEQ ID NO: 117240 - DNA, 1118 bp, Homo sapiens
  Payload ID: 2893
  Gene Symbol: CBY1
  Gene Name: chibby homolog 1 (Drosophila)
  ENST ID: ENST00000619293
  CDS Start-End: 1-510
atggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgtt

SEQ ID NO: 117241 - DNA, 785 bp, Homo sapiens
  Payload ID: 2894
  Gene Symbol: CBY3
  Gene Name: chibby homolog 3 (Drosophila)
  Uniprot ID: A6NI87
  ENST ID: ENST00000376974
  CDS Start-End: 57-785
tgaggactaacggggaaacatcctccgagaagatacaatctcaagggtgggcctggatgtgggcttccagagaccatctccctgaaccagatcttggggatgcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgccactgcgccgcatgccctccctgtccaccttctacctgctggaccacaacacgcgccaggccgagctgggcctcgcctacggcgcgccgtgcatgcgcctcagcaaccaggccttcgtgttccgcggcgggcggtggaccactgagagccagctggcgaggacgcggtcgccgctgctctcgcggaccgcctggggctggaaggcgcaggtgcagcggtccaaaagccaagtgttgctggaggagaacaactacctgaagctgcagcaggaactgctcatagacatgctgactgagaccatggcgcgcatgcacttgctggagaagcagcgcaaccccgaggtgatcccgacggctgcggcgcgcgccgggcagaggaagatgcgcaagcgcgcaggcgccagcgcgggcgtgctcatgatccagccgtgcgctctggactcgcagtga

SEQ ID NO: 117242 - DNA, 2047 bp, Homo sapiens
  Payload ID: 2895
  Gene Symbol: CHN1
  Gene Name: chimerin 1
  Uniprot ID: P15882
  ENST ID: ENST00000295497
  CDS Start-End: 419-1423
agtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagc

SEQ ID NO: 117243 - DNA, 779 bp, Homo sapiens
  Payload ID: 2895
  Gene Symbol: CHN1
  Gene Name: chimerin 1
  ENST ID: ENST00000409089
  CDS Start-End: 196-779
actcaagtttttagaagctagaatatagatccctttaagaaaaaaaaaggaagaaagaagaatttgctgttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagttctggaggccaggaagtccaagatcaagctggcagcaggttcagtgtctgattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagag

SEQ ID NO: 117244 - DNA, 1445 bp, Homo sapiens
  Payload ID: 2895
  Gene Symbol: CHN1
  Gene Name: chimerin 1
  ENST ID: ENST00000409597
  CDS Start-End: 17-844
ccatgatgaaaggaggatggctaccatgggactgttgatgctgctgacactagcagcttctcctcactttttgagtatttgctttcaccatgtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccatac

SEQ ID NO: 117245 - DNA, 1761 bp, Homo sapiens
  Payload ID: 2895
  Gene Symbol: CHN1
  Gene Name: chimerin 1
  Uniprot ID: P15882
  ENST ID: ENST00000409156
  CDS Start-End: 333-1634
atcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaag

SEQ ID NO: 117246 - DNA, 2447 bp, Homo sapiens
  Payload ID: 2895
  Gene Symbol: CHN1
  Gene Name: chimerin 1
  Uniprot ID: P15882
  ENST ID: ENST00000409900
  CDS Start-End: 315-1694
gccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaata

SEQ ID NO: 117247 - DNA, 561 bp, Homo sapiens
  Payload ID: 2895
  Gene Symbol: CHN1
  Gene Name: chimerin 1
  ENST ID: ENST00000444573
  CDS Start-End: 68-561
gttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagttctggaggccaggaagtccaagatcaagctggcagcaggttcagtgtctgattgtggtttgaatgttcataagcagtgttccaagatggtcccaaatgactgtaagccagacttgaagcatgtcaaaaaggtgtacagctgtgaccttacgacgct

SEQ ID NO: 117248 - DNA, 873 bp, Homo sapiens
  Payload ID: 2895
  Gene Symbol: CHN1
  Gene Name: chimerin 1
  ENST ID: ENST00000425395
  CDS Start-End: 309-380
cgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttactgtttcatggcatgatctccagagaagcagccgaccagctcttgattgtggctgaggggagctacctcatccgggagagccagcggcagccagggacctacactttggctttaagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagat

SEQ ID NO: 117249 - DNA, 564 bp, Homo sapiens
  Payload ID: 2895
  Gene Symbol: CHN1
  Gene Name: chimerin 1
  ENST ID: ENST00000443238
  CDS Start-End: 7-564
acttacatgagaggagggagaaacagagacagattgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctac

SEQ ID NO: 117250 - DNA, 582 bp, Homo sapiens
  Payload ID: 2895
  Gene Symbol: CHN1
  Gene Name: chimerin 1
  ENST ID: ENST00000413882
  CDS Start-End: 27-582
aatgaattgaccatgatgaaaggaggatggctaccatgggactgttgatgctgctgacactagcagcttctcctcactttttgagtatttgctttcaccatgtatgcgtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgcca

SEQ ID NO: 117251 - DNA, 898 bp, Homo sapiens
  Payload ID: 2895
  Gene Symbol: CHN1
  Gene Name: chimerin 1
  ENST ID: ENST00000444394
  CDS Start-End: 380-898
gaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctgttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatg

SEQ ID NO: 117252 - DNA, 569 bp, Homo sapiens
  Payload ID: 2895
  Gene Symbol: CHN1
  Gene Name: chimerin 1
  ENST ID: ENST00000451799
  CDS Start-End: 227-295
agtgcggcgccgcctctccgccagccactgcgccgcggccaagcctcctgcctcgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttactacatcctttaatatccccacaaagaactggggaaaataaatgaccagattatggagaacagagccaaatatccagcactgacttgttataagtatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacacttt

SEQ ID NO: 117253 - DNA, 3530 bp, Homo sapiens
  Payload ID: 2896
  Gene Symbol: CHN2
  Gene Name: chimerin 2
  Uniprot ID: P52757
  ENST ID: ENST00000222792
  CDS Start-End: 531-1937
ttcttcctttgtgtgtgcgcgagcggagttggggcggagggagaagggggaggtcgctctgtctgtccgtctcccgccgcctctgcccggtctactcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 117254 - DNA, 2375 bp, Homo sapiens
  Payload ID: 2896
  Gene Symbol: CHN2
  Gene Name: chimerin 2
  ENST ID: ENST00000409041
  CDS Start-End: 1-783
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 117255 - DNA, 539 bp, Homo sapiens
  Payload ID: 2896
  Gene Symbol: CHN2
  Gene Name: chimerin 2
  ENST ID: ENST00000409350
  CDS Start-End: 18-539
gcgaggggcgcgcggagatggcagcgtccagcaactccagcctgtccggctcgtcggtgtcctccgtctattctgaacccagaagcccgagagagcttccaaaatatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccacccta

SEQ ID NO: 117256 - DNA, 755 bp, Homo sapiens
  Payload ID: 2896
  Gene Symbol: CHN2
  Gene Name: chimerin 2
  ENST ID: ENST00000439711
  CDS Start-End: 1-594
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 117257 - DNA, 825 bp, Homo sapiens
  Payload ID: 2896
  Gene Symbol: CHN2
  Gene Name: chimerin 2
  Uniprot ID: P52757
  ENST ID: ENST00000421775
  CDS Start-End: 1-825
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 117258 - DNA, 542 bp, Homo sapiens
  Payload ID: 2896
  Gene Symbol: CHN2
  Gene Name: chimerin 2
  ENST ID: ENST00000446446
  CDS Start-End: 1-542
aaccccatctatgaacacattggatatgccaccctactcagagaaaaagtatccagaaggctgagcaggtctaaaaatgaaccaagaaaaacaaacgtcacacatgaagaacacacagcggtggaaaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtattt

SEQ ID NO: 117259 - DNA, 546 bp, Homo sapiens
  Payload ID: 2896
  Gene Symbol: CHN2
  Gene Name: chimerin 2
  ENST ID: ENST00000433720
  CDS Start-End: 1-275
aagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaagtaagctcatgtctcgtgcacaaagcctgctctgctcctagagcggttaatgcatgaggaaaagtggacggcattcctccccagccataactgctggagtttcactgtgccaggaaccactccaggcactttcagtgtatcatccctatgaaaggggcgccactgtgatggctcacgcctgtaatcccagcactttgggaggccgaggtgggcggatcatgaggtcaggagattgagaccatcctggctaacacggtgaaaccctgtctctacta

SEQ ID NO: 117260 - DNA, 2404 bp, Homo sapiens
  Payload ID: 2896
  Gene Symbol: CHN2
  Gene Name: chimerin 2
  ENST ID: ENST00000435288
  CDS Start-End: 438-812
actcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 117261 - DNA, 2279 bp, Homo sapiens
  Payload ID: 2896
  Gene Symbol: CHN2
  Gene Name: chimerin 2
  ENST ID: ENST00000424025
  CDS Start-End: 1-687
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 117262 - DNA, 578 bp, Homo sapiens
  Payload ID: 2896
  Gene Symbol: CHN2
  Gene Name: chimerin 2
  ENST ID: ENST00000439384
  CDS Start-End: 16-578
ctcctctaggctcacatgacccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcaatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaaca

SEQ ID NO: 117263 - DNA, 725 bp, Homo sapiens
  Payload ID: 2896
  Gene Symbol: CHN2
  Gene Name: chimerin 2
  ENST ID: ENST00000495789
  CDS Start-End: 1-651
atggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaggacagcaccctgaccaccctgcatgatatgcggtaccaaaagctgattgtgcagattttaatagaaaacgaagacgttttattctaa

SEQ ID NO: 117264 - DNA, 570 bp, Homo sapiens
  Payload ID: 2896
  Gene Symbol: CHN2
  Gene Name: chimerin 2
  ENST ID: ENST00000539389
  CDS Start-End: 1-570
atggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 117265 - DNA, 754 bp, Homo sapiens
  Payload ID: 2896
  Gene Symbol: CHN2
  Gene Name: chimerin 2
  ENST ID: ENST00000474070
  CDS Start-End: 1-410
acagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcagatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaag

SEQ ID NO: 117266 - DNA, 549 bp, Homo sapiens
  Payload ID: 2896
  Gene Symbol: CHN2
  Gene Name: chimerin 2
  ENST ID: ENST00000539406
  CDS Start-End: 1-549
atggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 117267 - DNA, 989 bp, Homo sapiens
  Payload ID: 2896
  Gene Symbol: CHN2
  Gene Name: chimerin 2
  ENST ID: ENST00000423511
  CDS Start-End: 878-989
gccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaaggagctgcttccacctgtctcctgtgcccttggtttctgctaatcctacattccaagaataaaagtcttcctatgcgttcctaggcagaagccaagtttccctgctttgggcacgttcaaaatagaaggtattttccgcttctcttgcttctgagcacccacgaaatcaacacatccccaaaacacgcgttgagggagtaagggaaagtgtcctgcacccgccaccctcccgcgctaagagcggcagaggaccccacagcttcgtacttccccggaggagctcctggagtaggagacggcttctagcctggaagaaccccgggtgcgacagttgtgccaggaaacttcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctcacatgacccagacccacagggcaaaaagtgcgtcgtcgtgtcccaacctcctggtcccagaaacctggccgcatcaagtcagcgcttcccatgctggaagaagcaagcagcccc

SEQ ID NO: 117268 - DNA, 2991 bp, Homo sapiens
  Payload ID: 2896
  Gene Symbol: CHN2
  Gene Name: chimerin 2
  Uniprot ID: P52757
  ENST ID: ENST00000412711
  CDS Start-End: 400-1398
gtgtgtttgagtgtgaaatgtgctaataaggaggagagacctctcctttgcaatgtgctgcggcaggagaaagcaggctgccggcccctgcctccctgaatcctcagtggctgactggataccgcttctgggggttgctgtgcacatgaatgtttgctattgttccaggcgcacgtcggccttaagaaatagcacaaaacaggcccatccttattcagaagccgggccccctccatcactcaaactgggcctttcaggtcacatgccggaggctgctgcagacaggacccagctgcctcaaatctgccgcctaacataagctgcggttcgaaaatcctgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 117269 - DNA, 1598 bp, Homo sapiens
  Payload ID: 2897
  Gene Symbol: CHIT1
  Gene Name: chitinase 1 (chitotriosidase)
  Uniprot ID: Q13231
  ENST ID: ENST00000255427
  CDS Start-End: 36-1379
tttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctc

SEQ ID NO: 117270 - DNA, 2246 bp, Homo sapiens
  Payload ID: 2897
  Gene Symbol: CHIT1
  Gene Name: chitinase 1 (chitotriosidase)
  Uniprot ID: Q13231
  ENST ID: ENST00000367229
  CDS Start-End: 36-1436
tttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctcttcccaaagatgtggtgacttaagaggctctctaagcacactgttgactccaaaacatccgcaggtcagagccaggtgggaaggtggtccgtgcaggatgtgccaggccctgtggcaggtcttgccccatgagtccatatgccagtgggcagtttccagtacacaggtgatggcagccagagcgcggccccaagtgcaacacgttctttggttattggctcagaagcctggaaacaggagcttctgcggaccttcacgcacgtgttattcccaaaatgccactagatggcagcagagaagaacttttccctgatttaagcgctctgcgagcagccactcagcattacactaagaattcagacccctggtactcaggggtcttcgagataaatcctgtttgggccctttgcaggccctatctcacctactgcccccgttcaccagatgaagaaggaacaatgattattctcactttataggcatttaaactgaagactgattctaaccaattctgagtccagaaccaaggcctgaaatgggccagagagcatgcacacggtgtcctggttaaataaagtcatcccaacattc

SEQ ID NO: 117271 - DNA, 1605 bp, Homo sapiens
  Payload ID: 2897
  Gene Symbol: CHIT1
  Gene Name: chitinase 1 (chitotriosidase)
  ENST ID: ENST00000503786
  CDS Start-End: 36-1121
tttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcatgcttacgttaagacaaggagactgcaaaatgactgatgtccaagcagcatgaggactcagcatccaggctcccagcccaaggctgtctccagaatctacagccactcacaggcctgaggctgctggagcaaaaagggccctgtccagaagaggtcagctatctgaagcagaagggactgggcggggccatggtctgggcactggacttagatgactttgccggcttctcctgcaaccagggccgataccccctcatccagacgctacggcaggaactgaatgggtaaagccttaactgcctgtcacatgtgaggccaggtgttgcctgtggcactgtgcttcagctgtaggtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagc

SEQ ID NO: 117272 - DNA, 1700 bp, Homo sapiens
  Payload ID: 2897
  Gene Symbol: CHIT1
  Gene Name: chitinase 1 (chitotriosidase)
  Uniprot ID: Q13231
  ENST ID: ENST00000491855
  CDS Start-End: 10-1173
agctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgaatgggtaaagccttaactgcctgtcacatgtgaggccaggtgttgcctgtggcactgtgcttcagctgtaggtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctc

SEQ ID NO: 117273 - DNA, 1792 bp, Homo sapiens
  Payload ID: 2898
  Gene Symbol: CHI3L1
  Gene Name: chitinase 3-like 1 (cartilage glycoprotein-39)
  Uniprot ID: P36222
  ENST ID: ENST00000255409
  CDS Start-End: 127-1278
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgtggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtg

SEQ ID NO: 117274 - DNA, 921 bp, Homo sapiens
  Payload ID: 2898
  Gene Symbol: CHI3L1
  Gene Name: chitinase 3-like 1 (cartilage glycoprotein-39)
  ENST ID: ENST00000404436
  CDS Start-End: 1-457
gctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgtggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctactt

SEQ ID NO: 117275 - DNA, 1489 bp, Homo sapiens
  Payload ID: 2899
  Gene Symbol: CHI3L2
  Gene Name: chitinase 3-like 2
  Uniprot ID: Q15782
  ENST ID: ENST00000369744
  CDS Start-End: 121-1263
cacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagtaa

SEQ ID NO: 117276 - DNA, 1468 bp, Homo sapiens
  Payload ID: 2899
  Gene Symbol: CHI3L2
  Gene Name: chitinase 3-like 2
  Uniprot ID: Q15782
  ENST ID: ENST00000369748
  CDS Start-End: 72-1244
gacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagt

SEQ ID NO: 117277 - DNA, 914 bp, Homo sapiens
  Payload ID: 2899
  Gene Symbol: CHI3L2
  Gene Name: chitinase 3-like 2
  ENST ID: ENST00000486561
  CDS Start-End: 310-914
tctcagcactttgggaggccaaggcaggaggggcgcttgagcccaggaattcaagaccagcctgggaccgggtcccttttaggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaa

SEQ ID NO: 117278 - DNA, 732 bp, Homo sapiens
  Payload ID: 2899
  Gene Symbol: CHI3L2
  Gene Name: chitinase 3-like 2
  ENST ID: ENST00000467038
  CDS Start-End: 297-732
atcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactaca

SEQ ID NO: 117279 - DNA, 1435 bp, Homo sapiens
  Payload ID: 2899
  Gene Symbol: CHI3L2
  Gene Name: chitinase 3-like 2
  Uniprot ID: Q15782
  ENST ID: ENST00000524472
  CDS Start-End: 230-1165
aacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggtaacagtccaggctggagctgggagtgggcagacagctgggcagaacagggcacaggagactgggggagatcatcttcacatatttggactaatcctttctcatgctcctttggctcttctgccatgttttcttagcaattaggctggttctgcccttttcataggcttcccatagacttttaaagtaataataataatattgataaattttggctaccatttattgagcatagtatgagctaaagactttcattacatatatatta

SEQ ID NO: 117280 - DNA, 482 bp, Homo sapiens
  Payload ID: 2899
  Gene Symbol: CHI3L2
  Gene Name: chitinase 3-like 2
  ENST ID: ENST00000533831
  CDS Start-End: 1-482
actttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaaggagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcc

SEQ ID NO: 117281 - DNA, 778 bp, Homo sapiens
  Payload ID: 2899
  Gene Symbol: CHI3L2
  Gene Name: chitinase 3-like 2
  ENST ID: ENST00000497220
  CDS Start-End: 1-552
ccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtgatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagtaa

SEQ ID NO: 117282 - DNA, 339 bp, Homo sapiens
  Payload ID: 2899
  Gene Symbol: CHI3L2
  Gene Name: chitinase 3-like 2
  ENST ID: ENST00000472825
  CDS Start-End: 1-129
tatgagatctgccagttcctgaaaggagccaagatcacgcggctccaggatcagcaggttccctacgcagtcaaggggaaccagtgggtgggctatgatgatgtgaagagtatggagaccaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgc

SEQ ID NO: 117283 - DNA, 589 bp, Homo sapiens
  Payload ID: 2899
  Gene Symbol: CHI3L2
  Gene Name: chitinase 3-like 2
  ENST ID: ENST00000497587
  CDS Start-End: 222-589
tgtatgtgagcacacccacattttcactgccattatctgggacagcagaaccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaa

SEQ ID NO: 117284 - DNA, 946 bp, Homo sapiens
  Payload ID: 2899
  Gene Symbol: CHI3L2
  Gene Name: chitinase 3-like 2
  ENST ID: ENST00000528451
  CDS Start-End: 285-946
aggtgcctggtaaacaatagctgttgtcgggtgtggtggctcacacttgtaatctcagcactttgggaggccaaggcaggaggggcgcttgagcccaggaattcaagaccagcctgggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagcc

SEQ ID NO: 117285 - DNA, 757 bp, Homo sapiens
  Payload ID: 2899
  Gene Symbol: CHI3L2
  Gene Name: chitinase 3-like 2
  ENST ID: ENST00000477185
  CDS Start-End: 250-757
gaaaccacagcagctgtggctggggagcccagatgaagtgtggctctatcttgtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctg

SEQ ID NO: 117286 - DNA, 600 bp, Homo sapiens
  Payload ID: 2899
  Gene Symbol: CHI3L2
  Gene Name: chitinase 3-like 2
  ENST ID: ENST00000474304
  CDS Start-End: 53-600
agtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgagttagcagaagcctttcagaaggacttcacaaaatccaccaaggaaaggcttctcttgactgcgggcgtatctgcagggaggcaaatgattgataacagctatcaagttgagaaactggcaaa

SEQ ID NO: 117287 - DNA, 2169 bp, Homo sapiens
  Payload ID: 2899
  Gene Symbol: CHI3L2
  Gene Name: chitinase 3-like 2
  Uniprot ID: Q15782
  ENST ID: ENST00000445067
  CDS Start-End: 772-1944
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcgctctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 117288 - DNA, 1518 bp, Homo sapiens
  Payload ID: 2899
  Gene Symbol: CHI3L2
  Gene Name: chitinase 3-like 2
  Uniprot ID: Q15782
  ENST ID: ENST00000466741
  CDS Start-End: 358-1293
aaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 117289 - DNA, 3374 bp, Homo sapiens
  Payload ID: 2900
  Gene Symbol: CHID1
  Gene Name: chitinase domain containing 1
  Uniprot ID: Q9BWS9
  ENST ID: ENST00000323578
  CDS Start-End: 731-1912
gaatgcgcggtgactcaaaagtgctggccacgcgctcgttcatccaagcgcgaggggctgagttgggaacttggtttgcctcctggggctccggctcgtgcaatgtgcaaggcgggggtgcggaccgagagagcgcgcgtttcgggcagtccccgctggagacagcgcagtgggcgccatcggcctggggatggagatggtccactcaggcgggggtcggggggacgccaggagtggtgactccgggtccccgggggagcgtgccggggcggagcccaccgcgcggttctcccggcaccgccgagccgggcagaggccctggagcccaaggccccgcgcggccccacgccaagggcgccaggcctgcctaagagccgtggcgctgggaacccggctacccctgggccgggaacctgataaccagctccagcgcgagcaccaggggcgctcaaggtgaacgcgccgggcccggggtccgcccccggcgcggccccgccccggccccggccccggccccggccccgactttcgggcagccctgcccagtcccctgtcctggcccagcccctctccatcccagcgtgccgtgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaag

SEQ ID NO: 117290 - DNA, 1477 bp, Homo sapiens
  Payload ID: 2900
  Gene Symbol: CHID1
  Gene Name: chitinase domain containing 1
  Uniprot ID: Q9BWS9
  ENST ID: ENST00000436108
  CDS Start-End: 205-1386
gcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgc

SEQ ID NO: 117291 - DNA, 3537 bp, Homo sapiens
  Payload ID: 2900
  Gene Symbol: CHID1
  Gene Name: chitinase domain containing 1
  Uniprot ID: Q9BWS9
  ENST ID: ENST00000449825
  CDS Start-End: 358-1539
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 117292 - DNA, 3255 bp, Homo sapiens
  Payload ID: 2900
  Gene Symbol: CHID1
  Gene Name: chitinase domain containing 1
  Uniprot ID: Q9BWS9
  ENST ID: ENST00000454838
  CDS Start-End: 1-1257
atgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 117293 - DNA, 1289 bp, Homo sapiens
  Payload ID: 2900
  Gene Symbol: CHID1
  Gene Name: chitinase domain containing 1
  Uniprot ID: Q9BWS9
  ENST ID: ENST00000429789
  CDS Start-End: 105-1193
cggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 117294 - DNA, 602 bp, Homo sapiens
  Payload ID: 2900
  Gene Symbol: CHID1
  Gene Name: chitinase domain containing 1
  ENST ID: ENST00000529539
  CDS Start-End: 1-325
cccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaaga

SEQ ID NO: 117295 - DNA, 1171 bp, Homo sapiens
  Payload ID: 2900
  Gene Symbol: CHID1
  Gene Name: chitinase domain containing 1
  ENST ID: ENST00000534207
  CDS Start-End: 1-254
aggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagc

SEQ ID NO: 117296 - DNA, 594 bp, Homo sapiens
  Payload ID: 2900
  Gene Symbol: CHID1
  Gene Name: chitinase domain containing 1
  ENST ID: ENST00000528154
  CDS Start-End: 515-594
acagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccaggtaaggcatggggtctcctaaagcagggatccagtcagcagcagaaacactcatctctgcaggcctcctcaccccaccggcctgcccctgccctactctgtcccccccatgcccacggcagacaggcagtgggcaagcaggagggcctcagggcaggtcagacctgggcctacagggcagagcctggacctccgccagggcactccacacccaccccggccctctggaccccgaggttggaccctactgtgacacacctaccatgcggacactcttcaacctcctctggcttgccctggcctgcagccctgttcacactaccctgtcaaagtcagatgccaa

SEQ ID NO: 117297 - DNA, 991 bp, Homo sapiens
  Payload ID: 2900
  Gene Symbol: CHID1
  Gene Name: chitinase domain containing 1
  ENST ID: ENST00000528426
  CDS Start-End: 299-553
gcctccctgacatgcaggtgagccccgcggcggccggcccctgctcctcctccttgcacggcctcagtttccctcccgcaaagtgggcgcgccgggcagcgaggctcggccccgggaggacgggcgtggggtcgcgggcgacgccgggcggatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggctggagcgcaatggcgcgatcttggctcaccgcaacctctgccacccaggttcaagcgattctcctgcttcagcctcccgagtagctgggactacagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaa

SEQ ID NO: 117298 - DNA, 1019 bp, Homo sapiens
  Payload ID: 2900
  Gene Symbol: CHID1
  Gene Name: chitinase domain containing 1
  ENST ID: ENST00000534254
  CDS Start-End: 167-655
tccttcctccctgacccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaaggttctcatccttcctgcttgactgtgcttgccccacaggctgaaaagagtggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatca

SEQ ID NO: 117299 - DNA, 523 bp, Homo sapiens
  Payload ID: 2900
  Gene Symbol: CHID1
  Gene Name: chitinase domain containing 1
  ENST ID: ENST00000525225
  CDS Start-End: 272-523
ccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagcctctcggaactgccgtggctgttcaagcactcactgcctttgcctgtggctccatgtactgggtgctgctgtgcttgccctccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctat

SEQ ID NO: 117300 - DNA, 619 bp, Homo sapiens
  Payload ID: 2900
  Gene Symbol: CHID1
  Gene Name: chitinase domain containing 1
  ENST ID: ENST00000532909
  CDS Start-End: 1-210
ctgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctagagagccacccagacgtccccaccgagtccagcacggcaagggtgcaggggctgccctagaaatgggctcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaaga

SEQ ID NO: 117301 - DNA, 834 bp, Homo sapiens
  Payload ID: 2900
  Gene Symbol: CHID1
  Gene Name: chitinase domain containing 1
  ENST ID: ENST00000531859
  CDS Start-End: 162-834
cctccctgacccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggt

SEQ ID NO: 117302 - DNA, 323 bp, Homo sapiens
  Payload ID: 2900
  Gene Symbol: CHID1
  Gene Name: chitinase domain containing 1
  ENST ID: ENST00000528521
  CDS Start-End: 1-217
ccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtacatccagacactgaaggaccacaggccccggatggtgtgggacagccaggcctcagagcacttcttcgagtacaagaagagccgcagtgggaggcacgtcgtcttctacccaaccctgaa

SEQ ID NO: 117303 - DNA, 1431 bp, Homo sapiens
  Payload ID: 2900
  Gene Symbol: CHID1
  Gene Name: chitinase domain containing 1
  Uniprot ID: Q9BWS9
  ENST ID: ENST00000528581
  CDS Start-End: 80-1336
gtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtg

SEQ ID NO: 117304 - DNA, 438 bp, Homo sapiens
  Payload ID: 2900
  Gene Symbol: CHID1
  Gene Name: chitinase domain containing 1
  ENST ID: ENST00000525840
  CDS Start-End: 323-438
agacacaaacccagccccaaaggccccacagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtaag

SEQ ID NO: 117305 - DNA, 578 bp, Homo sapiens
  Payload ID: 2900
  Gene Symbol: CHID1
  Gene Name: chitinase domain containing 1
  ENST ID: ENST00000533059
  CDS Start-End: 222-578
gcactggccagcctggggaagacacaaacccagccccaaaggccccacagccaccaggcacctccaacaaccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgag

SEQ ID NO: 117306 - DNA, 752 bp, Homo sapiens
  Payload ID: 2900
  Gene Symbol: CHID1
  Gene Name: chitinase domain containing 1
  ENST ID: ENST00000533056
  CDS Start-End: 358-752
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagg

SEQ ID NO: 117307 - DNA, 571 bp, Homo sapiens
  Payload ID: 2900
  Gene Symbol: CHID1
  Gene Name: chitinase domain containing 1
  ENST ID: ENST00000530939
  CDS Start-End: 225-571
gttttccggccgtgcgtttgtggccgtccggcctccctgacatgcaggtgagccccgcggcggccggcccctgctcctcctccttgcacggcctcagtttccctcccgcaaagtgggcgcgccgggcagcgaggctcggccccgggaggacgggcgtggggtcgcgggcgacgccgggcggccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacg

SEQ ID NO: 117308 - DNA, 1482 bp, Homo sapiens
  Payload ID: 2901
  Gene Symbol: CHIA
  Gene Name: chitinase, acidic
  ENST ID: ENST00000352594
  CDS Start-End: 146-451
cgggactggtgctgactgcaaccatgacaaagcttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcagatgaggaaactaaagtacagagaggatttaagcaacttgcccaagatcacacaactagtaggaatcataacttcctctgcagtttggccacagagtccattgcttctaagcattacactaggctgcccgttattactgagaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 117309 - DNA, 1214 bp, Homo sapiens
  Payload ID: 2901
  Gene Symbol: CHIA
  Gene Name: chitinase, acidic
  Uniprot ID: Q9BZP6
  ENST ID: ENST00000353665
  CDS Start-End: 258-1205
accatgacaaagcttattctcctcacaggtcttgtccttatactgaatttgcagctcggaacagccagctgaaaactctcctggccattggaggctggaacttcgggactgccccatgaggaaactaaagtacagagaggatttaagcaacttgcccaagatcacacaactagtaggaatcataacttcctctgcagtttggccacagagtccattgcttctaagcattacactaggctgcccgttattactgagaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacct

SEQ ID NO: 117310 - DNA, 1624 bp, Homo sapiens
  Payload ID: 2901
  Gene Symbol: CHIA
  Gene Name: chitinase, acidic
  Uniprot ID: Q9BZP6
  ENST ID: ENST00000343320
  CDS Start-End: 95-1525
tctgggtcaaattgttctctatttagaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtaccggccaggcctggggcgcttcatgcctgacaacatcgacccctgcctctgtacccacctgatctacgcctttgctgggaggcagaacaacgagatcaccaccatcgaatggaatgatgtgactctctaccaagctttcaatggcctgaaaaataagaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatg

SEQ ID NO: 117311 - DNA, 1625 bp, Homo sapiens
  Payload ID: 2901
  Gene Symbol: CHIA
  Gene Name: chitinase, acidic
  Uniprot ID: Q9BZP6
  ENST ID: ENST00000369740
  CDS Start-End: 104-1534
gctttccagtctggtggtgaatcctccatagtctgaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtaccggccaggcctggggcgcttcatgcctgacaacatcgacccctgcctctgtacccacctgatctacgcctttgctgggaggcagaacaacgagatcaccaccatcgaatggaatgatgtgactctctaccaagctttcaatggcctgaaaaataagaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 117312 - DNA, 1354 bp, Homo sapiens
  Payload ID: 2901
  Gene Symbol: CHIA
  Gene Name: chitinase, acidic
  ENST ID: ENST00000422815
  CDS Start-End: 1-1263
gaaacctcctcgtctgtgcacgaacaggtggccgactctggagcccaggctgttgctttccagtctggtggtgaatcctccatagtctggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 117313 - DNA, 1256 bp, Homo sapiens
  Payload ID: 2901
  Gene Symbol: CHIA
  Gene Name: chitinase, acidic
  Uniprot ID: Q9BZP6
  ENST ID: ENST00000451398
  CDS Start-End: 210-1157
tctgggtcaaattgttctctatttagaagcctttgtgataaccacagaatcagaacatataaaaagctctgcgggactggtgctgactgcaaccatgacaaagcttattctcctcacaggtcttgtccttatactgaatttgcagctcggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatg

SEQ ID NO: 117314 - DNA, 1320 bp, Homo sapiens
  Payload ID: 2901
  Gene Symbol: CHIA
  Gene Name: chitinase, acidic
  Uniprot ID: Q9BZP6
  ENST ID: ENST00000430615
  CDS Start-End: 114-1220
cttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatga

SEQ ID NO: 117315 - DNA, 977 bp, Homo sapiens
  Payload ID: 2901
  Gene Symbol: CHIA
  Gene Name: chitinase, acidic
  ENST ID: ENST00000489524
  CDS Start-End: 116-977
atgacaaagcttattctcctcacaggtcttgtccttatactgaatttgcagctcggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggc

SEQ ID NO: 117316 - DNA, 1188 bp, Homo sapiens
  Payload ID: 2901
  Gene Symbol: CHIA
  Gene Name: chitinase, acidic
  Uniprot ID: Q9BZP6
  ENST ID: ENST00000483391
  CDS Start-End: 150-1097
gaaacctcctcgtctgtgcacgaacaggtggccgactctggagcccaggctgttgctttccagtctggtggtgaatcctccatagtctggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 117317 - DNA, 1633 bp, Homo sapiens
  Payload ID: 2902
  Gene Symbol: CTBS
  Gene Name: chitobiase, di-N-acetyl-
  ENST ID: ENST00000370625
  CDS Start-End: 7-240
gctgctatgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtcagcgccttcctctgctcctctaggtctgggcttcagggcacgaagagaagttagggtagaacggagccctaaggagaggtgccgtgggcgccgaaaccagctttgaccactcgatgagggccttcctgtttacggatccttcaatttatagatgaggaagctcgggctcagagaagttgagtaactcctcaggcctcacagcctgtaagtgcctgcgtaggcaggcgagagttcaaaccagatctgcctcctaaggcaagctcctttcattcccctgctgtgcctctgcggaagcactctgggtgtaaaaagcaaacaaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttg

SEQ ID NO: 117318 - DNA, 6600 bp, Homo sapiens
  Payload ID: 2902
  Gene Symbol: CTBS
  Gene Name: chitobiase, di-N-acetyl-
  Uniprot ID: Q01459
  ENST ID: ENST00000370630
  CDS Start-End: 50-1207
cgcccacccaggcggtaggaacccactccggcccgctagacctgctgctatgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacctaattgagattgtagagatgtattattttttttttctgtgccagttcagttttcaatgttcgtaaatctgaaactgcttgttttctcatctataaaaagaattacttttcaaaaatgaacttcatcatacccttctaaaagtacatcatagttgtcatgtaaacagggtttttgtaaccgctttaactgtcttctctcatttggcttcagtgctttcaactcccactggattactacagtaaatgtgtagattatgaatgctgtttaataagcatgcttatctactggtgagatatgctataaggtaaccttgtttatgagtagatagggacaatacaattgaactgttctaaaaactagagtgagaaagaattttatgttttgcttaaacttcaaaacctgttgttctcaatgtgtaaagaaaatagtgaaaacaacaagaaaacaaaatacaaaaaaaacccttaattcctagcccttaggaacggaatagatatttcagaaatatagtgtttactctgtggcaagcactcttctaagtgtattagtctcttatttttttttcaaaaattttacagaatcagatactagtatttatccccattttacagttgaaatggagacctttagaggctaagtaacttgctcaagataaaaaactagtaagtgaagtgggtacagccaggattcaaattcaaaccacctggtaccagagcccttactattccaagtgttgtctgtggacagcagcattagcatcagttgggagcttgttaggtaggaagaatctcaggctgcacccagacctactgagtcagatcctgcatttttaaacaggatcctcagatgatatattaaactttgagaagcactacttatgctatactatcttgaataaatatggttgcaagagactcaggctgggttttttttgtcccttagttctgaatcttataggtagtgctgttttggggagatcattcagaaatcaataaaacttcttaaataatgtctgttatgtgtcaatcaggcactatggttaaatacaggattttttccccccagcctataagctgaaaactttgttctctttttttcctcttattccacttgtccttactgtttttgtatgaacaattctaatttgagttcaaaccatgagtgacatttgtaatgttaaaatatacaaagattacaagtaatgtgcatgctttccagaagaaaacagcatgaggggagtcataatccaagcctctgggggcatttttattactccttcctacctacccaattattaagtgtacaagtttacatattggctttatctccatatattgaatagacagttttccttcattgaacaaattattttttgagtgcatatttaactgatattttgttaaaaattatcctctgctcttttccttttctattttaagttttaagcttctcagtgccaaaccagggcttatttagcctcgagaatgctgcttgtaaaaagaatctagaactgcactgtccagtatagtagaagccagttgccatatgtaactactaaacttaaattaactaaaattaaataaaatttaaaattcagttcctcagtcacacaaactacatttcaagtgctcaatatcaataggtggctagtgggtaccaatctgacagtgcaggcatagaacatttctatcatcacataagttctgttggacagtgctaattctatttttttatttttaaattttatttatttttatttttatctgaaaccgaggacagtactgattttcttttttctttttaaaatttttttaaaaagagctaattctagaatgcagtcattattctgtgtcataaagctgtttctgataaagaaatgagagcattcatataattatcgttctcattttcctgccttgctgtgggtacttgtatgaaaatgtataatcttctgttttctgttcaacaaaaaagctttttaatacatatgtacttcacagataatttctatgatgtaattagttgtacacaattctcaccaaatagagcatgcccagaagcctctactaagcatctgctatacaaaaggtcccatgggagaaacaaagttaactaaggcatagtctctgccaggaaggaaacttaacatctagtagaagacacattattcatatttaaataatagaatacatatgaaaataaccagaaaaaatgaaacgattacccataaaaaattaaatgtcagttcagaggagagctcagtggtttatcagacttaataattctaatacaggaaaactacttaaaattttttttgagaatatattgactcacaggttccttttcctttaattcttcctagtaaaattttactaaattttactttggctttattatatcatgtatcttttcacaggtttagtttttcttcctgcattttttttttcacctatgctctttactgttaaggtaacaattttaatacagtcaatcctggctacccttatattattgacacccaaagttaaaacaccaaaatattttatttcaagataaatgttataataatctgattaggaaaaatgtaaattaccttaacttctactatgagtttcattttgtcagtatctagttttctcttaagctggtcaattgcatgctgtacctcagtgatctggattattaggtaattctgtgtggatagatagatatttatttagtataacatataaacatttttatttttaactgccttgtgaacataaactatgaaatgataaagatcaaaagagtaaatcatgaaaataacctattccgtaaagtaaactaaattgctttggagaaattactatttgtttctgttgatttcttgcattttagggaacactttctctaaagttaccattaaattagcatcgtaaaaaccaacaactattactatgaaaggaataatatcttagttattagcaagactttaaaattgtcataatgctttatcagctgaataagattagaattattttaaaatacttaataatatgatactatattttatatgcaaaaactaatttaatacaagaaaacctatttaaaataagaagactttttggtttttgtccagaaaagtttatgagttatagtggtcctcgctaaagaagttatttaagagttttaaactggctttgtgaaaaaattcttatattgaactgattaaacagtaagataaagtataagctatgctaaaaaaaaaagtaccaactactatggacaaaccattacttgagcctatttggactttatattaaatttatttaaaataataaacttttaatatttcatcttgtctaaagttaaatccttacttttaatcatagttaacatattttaaaattacttttggataagtgggattgatccaacccaaatcaaattgttaaatgccctcttgaatttttttgtctgttatttaattatatggtggaattaataataaaataaacttcatgtctctgattcaa

SEQ ID NO: 117319 - DNA, 1748 bp, Homo sapiens
  Payload ID: 2902
  Gene Symbol: CTBS
  Gene Name: chitobiase, di-N-acetyl-
  ENST ID: ENST00000465118
  CDS Start-End: 16-249
gctagacctgctgctatgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtcagcgccttcctctgctcctctaggtctgggcttcagggcacgaagagaagttagggtagaacggagccctaaggagaggtgccgtgggcgccgaaaccagctttgaccactcgatgagggccttcctgtttacggatccttcaatttatagatgaggaagctcgggctcagagaagttgagtaactcctcaggcctcacagcctgtaagtgcctgcgtaggcaggcgagagttcaaaccagatctgcctcctaaggcaagctcctttcattcccctgctgtgcctctgcggaagcactctgggtgtaaaaagcaaacaaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaaccta

SEQ ID NO: 117320 - DNA, 2816 bp, Homo sapiens
  Payload ID: 2903
  Gene Symbol: CHKB-CPT1B
  Gene Name: CHKB-CPT1B readthrough (NMD candidate)
  ENST ID: ENST00000453634
  CDS Start-End: 1-183
gaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctga

SEQ ID NO: 117321 - DNA, 3310 bp, Homo sapiens
  Payload ID: 2904
  Gene Symbol: CLCA1
  Gene Name: chloride channel accessory 1
  Uniprot ID: A8K7I4
  ENST ID: ENST00000234701
  CDS Start-End: 352-3096
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgcttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaaatgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaatgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggta

SEQ ID NO: 117322 - DNA, 3118 bp, Homo sapiens
  Payload ID: 2904
  Gene Symbol: CLCA1
  Gene Name: chloride channel accessory 1
  Uniprot ID: A8K7I4
  ENST ID: ENST00000394711
  CDS Start-End: 130-2874
gataaaccacttccgataagttggaaacgtgtgtctatattttcatatctgtatatatataatggtaaagaaagacaccttcgtaacccgcattttccaaagagagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgcttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaaatgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaatgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaaccc

SEQ ID NO: 117323 - DNA, 4025 bp, Homo sapiens
  Payload ID: 2905
  Gene Symbol: CLCA2
  Gene Name: chloride channel accessory 2
  Uniprot ID: Q9UQC9
  ENST ID: ENST00000370565
  CDS Start-End: 163-2994
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaattaaa

SEQ ID NO: 117324 - DNA, 3211 bp, Homo sapiens
  Payload ID: 2906
  Gene Symbol: CLCA4
  Gene Name: chloride channel accessory 4
  Uniprot ID: Q14CN2
  ENST ID: ENST00000370563
  CDS Start-End: 43-2802
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaa

SEQ ID NO: 117325 - DNA, 1316 bp, Homo sapiens
  Payload ID: 2907
  Gene Symbol: CLCC1
  Gene Name: chloride channel CLIC-like 1
  Uniprot ID: Q96S66
  ENST ID: ENST00000302500
  CDS Start-End: 12-1304
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagc

SEQ ID NO: 117326 - DNA, 1124 bp, Homo sapiens
  Payload ID: 2907
  Gene Symbol: CLCC1
  Gene Name: chloride channel CLIC-like 1
  Uniprot ID: Q96S66
  ENST ID: ENST00000348264
  CDS Start-End: 12-1112
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttgcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagc

SEQ ID NO: 117327 - DNA, 4803 bp, Homo sapiens
  Payload ID: 2907
  Gene Symbol: CLCC1
  Gene Name: chloride channel CLIC-like 1
  Uniprot ID: Q96S66
  ENST ID: ENST00000356970
  CDS Start-End: 109-1764
gcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 117328 - DNA, 4151 bp, Homo sapiens
  Payload ID: 2907
  Gene Symbol: CLCC1
  Gene Name: chloride channel CLIC-like 1
  Uniprot ID: Q96S66
  ENST ID: ENST00000369968
  CDS Start-End: 12-1112
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttgcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 117329 - DNA, 4343 bp, Homo sapiens
  Payload ID: 2907
  Gene Symbol: CLCC1
  Gene Name: chloride channel CLIC-like 1
  Uniprot ID: Q96S66
  ENST ID: ENST00000369969
  CDS Start-End: 12-1304
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 117330 - DNA, 2078 bp, Homo sapiens
  Payload ID: 2907
  Gene Symbol: CLCC1
  Gene Name: chloride channel CLIC-like 1
  Uniprot ID: Q96S66
  ENST ID: ENST00000369970
  CDS Start-End: 12-1517
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggactttttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatat

SEQ ID NO: 117331 - DNA, 2468 bp, Homo sapiens
  Payload ID: 2907
  Gene Symbol: CLCC1
  Gene Name: chloride channel CLIC-like 1
  ENST ID: ENST00000369976
  CDS Start-End: 263-1051
gaaaccctgggcggcggcaagctgtgcgacctcttctgcggccggcctgggcaggtgtcttcctcgagaggcaggcaggggatcccggacactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaact

SEQ ID NO: 117332 - DNA, 1172 bp, Homo sapiens
  Payload ID: 2908
  Gene Symbol: CLNS1A
  Gene Name: chloride channel, nucleotide -sensitive, 1A
  ENST ID: ENST00000263309
  CDS Start-End: 38-649
aactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagtggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgtttt

SEQ ID NO: 117333 - DNA, 667 bp, Homo sapiens
  Payload ID: 2908
  Gene Symbol: CLNS1A
  Gene Name: chloride channel, nucleotide -sensitive, 1A
  ENST ID: ENST00000527133
  CDS Start-End: 69-218
gggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaag

SEQ ID NO: 117334 - DNA, 1121 bp, Homo sapiens
  Payload ID: 2908
  Gene Symbol: CLNS1A
  Gene Name: chloride channel, nucleotide -sensitive, 1A
  ENST ID: ENST00000525064
  CDS Start-End: 59-598
gtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgtttt

SEQ ID NO: 117335 - DNA, 2993 bp, Homo sapiens
  Payload ID: 2908
  Gene Symbol: CLNS1A
  Gene Name: chloride channel, nucleotide -sensitive, 1A
  Uniprot ID: P54105
  ENST ID: ENST00000525428
  CDS Start-End: 92-805
ggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctatattactttgctctcattcttgactaaaaccattaatgagaaatgttttttaaaaaataatgctggcaaatatgagaattttgttggctttatttttgtttacttgttgagaagatgaacatgaaattaataagaaaatatagttatagcttctggcaagtatttagtaaggcaaagatttaacacatttcaggggatttctgccacttccttttagatcagcagtaatttcttatatttatcaactctcaatttttagttttcatagatacctgggtattataaggctgatttgtaattactgatttatacttggacttttgaaatcattatgtgtccttaaaaataaggttatacaagctaaccttcttaacaggatcacatggctaattagtgactaaactgatgtttggtaccactcagcccagtgttcatttcagcactgtcacttggtttcccttatcttgcaaggtagactgaaaaaaaacgaattttcctttttctaaccagactctcagaatttctgagtctgttaacaataggcaagtaaaacagccacttgaaatggaaactaaaatttactgagacctctgtactagccactgtcctgagttctttattatgtattataatattcttaattatcttatgagatacgcttttatcccactttatagttgaggaaactgagttatagagagaggtaaaataacttgcttaaggtcatgtagatagtgaattgtgatttttgagcctgtgctttaaaacatcatacagccttaccacctaccagcagcagaaagcatgcacactctccccactgctgcagggtttcagtgttaacatttcaatggccagtacaagagcttccccagtttctctgctacccatctgagcaacacccataattctatcctagaagtttgtccattcttcagtaatcagtcaggacattctcacaggctaatattagaaattccatttgagttccttttaaaaggaacaaatttataattgtgactttccatgaacataaattgctctgatagcaaaatgtcgagaagattcagagtgtacttggtttcttgttggtgttgctgtggtcaatgcaatatgcaaaaaggcaggagaccaaagcatgtgggcacctctctgggcttatttcctcattagactaagtgactttcaaagattgagctgtaacattcactagatagttagaaccgtagcattgagaaaatagaagctgagaaaaaagagcaggtcaggcttttaaaagataaaatttataatgatcagccagacaatatttattgatttcatttgagcctaattttagggttgctggaattgttttctttgtgtgttcctgatgtagagacactttaaaggtacatagacatttcccctccaaaatgtaagtcatctaaatgttcctaaaagctagggttaatggttctctgttctaggttcttcatttaaaaaatgtattcattaagatatggtcccagccggacgtggtggctcacacctgtaatcccagcactttgggaggctcaggtgggcagatcacttgaggtcaggagtttgagaccagcctggccaatacggtgaaaacccatctct

SEQ ID NO: 117336 - DNA, 953 bp, Homo sapiens
  Payload ID: 2908
  Gene Symbol: CLNS1A
  Gene Name: chloride channel, nucleotide -sensitive, 1A
  Uniprot ID: P54105
  ENST ID: ENST00000528364
  CDS Start-End: 63-776
tgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagaaaccagccttttaaagttccagttagcttccaagttactgctattgtgaaaactgtataacattgcttcttatactgaccatgaattgtgatactggacctgtgctttcttctcacatcctgccagtggaactatcagaaaataacctcttaga

SEQ ID NO: 117337 - DNA, 898 bp, Homo sapiens
  Payload ID: 2908
  Gene Symbol: CLNS1A
  Gene Name: chloride channel, nucleotide -sensitive, 1A
  ENST ID: ENST00000532069
  CDS Start-End: 81-584
ctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcattt

SEQ ID NO: 117338 - DNA, 747 bp, Homo sapiens
  Payload ID: 2908
  Gene Symbol: CLNS1A
  Gene Name: chloride channel, nucleotide -sensitive, 1A
  ENST ID: ENST00000526009
  CDS Start-End: 1-70
caggacagaagattcaataagagattatgaaggtatacacacacccaccaaagcaagagagagattttaagaaattggcccacgtgactgaaggctggcaagtccaaaatctgcatggtaagccggcagactggagacccagagaagagtttatgttgcattctgctgcctcagaagttctgctggcagaatttcttcttgctcaggggagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaac

SEQ ID NO: 117339 - DNA, 415 bp, Homo sapiens
  Payload ID: 2908
  Gene Symbol: CLNS1A
  Gene Name: chloride channel, nucleotide -sensitive, 1A
  ENST ID: ENST00000526761
  CDS Start-End: 1-68
atgggatggaggtggataccacaccaacagttgctggacagtttgaggatgcagatgttgatcactgaaaatgatttatgcaagtttaagaaggagtatctgggcctttcagcttctacagtggaaggacgctgccgctgtgcagatgctcacagtaccccagaagtcctcatgctagagatgtaaaaaggcatattcctataagaaaaacagccatgaaacagaagtcatgagacatcaatcaatatatgtaagaagaacgttggttcagtctggaaaggcatgacatcttgaagcaggaagggggcttccaggtcataggaaaaaggaggaaaaaaatgtactggggaacaagacaagatcaatcagactctgccactcttctgctgatccagctcaactatgatcttttttg

SEQ ID NO: 117340 - DNA, 3172 bp, Homo sapiens
  Payload ID: 2909
  Gene Symbol: CLCN1
  Gene Name: chloride channel, voltage-sensitive 1
  Uniprot ID: P35523
  ENST ID: ENST00000343257
  CDS Start-End: 88-3054
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagacgggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggcccagcctgagggtgaacttgtgtggggcagggtgcgtcctgaatgtggcgaggtcatgccaatgtcgtggcctcttcca

SEQ ID NO: 117341 - DNA, 491 bp, Homo sapiens
  Payload ID: 2909
  Gene Symbol: CLCN1
  Gene Name: chloride channel, voltage-sensitive 1
  ENST ID: ENST00000432192
  CDS Start-End: 1-229
catctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagcctgtgcctgtcctccaaatgtccacccctctttcacctgtggccccacatggagaccgtgcctgggcagcttgacctcctggtgtcggcctgtgcagtgggcgtgggatgctgctttgcagcccctgtcggagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgc

SEQ ID NO: 117342 - DNA, 569 bp, Homo sapiens
  Payload ID: 2909
  Gene Symbol: CLCN1
  Gene Name: chloride channel, voltage-sensitive 1
  ENST ID: ENST00000455478
  CDS Start-End: 1-307
catctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcctgtgcctgtcctccaaatgtccacccctctttcacctgtggccccacatggagaccgtgcctgggcagcttgacctcctggtgtcggcctgtgcagtgggcgtgggatgctgctttgcagcccctgtcggagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgc

SEQ ID NO: 117343 - DNA, 3290 bp, Homo sapiens
  Payload ID: 2910
  Gene Symbol: CLCN2
  Gene Name: chloride channel, voltage-sensitive 2
  Uniprot ID: P51788
  ENST ID: ENST00000265593
  CDS Start-End: 173-2869
gacgcgagcgggaggctgcgccagcggcgcccgccgggggcccgccgcactctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaa

SEQ ID NO: 117344 - DNA, 3187 bp, Homo sapiens
  Payload ID: 2910
  Gene Symbol: CLCN2
  Gene Name: chloride channel, voltage-sensitive 2
  Uniprot ID: P51788
  ENST ID: ENST00000344937
  CDS Start-End: 124-2769
ctctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattgatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatata

SEQ ID NO: 117345 - DNA, 2820 bp, Homo sapiens
  Payload ID: 2910
  Gene Symbol: CLCN2
  Gene Name: chloride channel, voltage-sensitive 2
  Uniprot ID: P51788
  ENST ID: ENST00000457512
  CDS Start-End: 125-2734
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggca

SEQ ID NO: 117346 - DNA, 1844 bp, Homo sapiens
  Payload ID: 2910
  Gene Symbol: CLCN2
  Gene Name: chloride channel, voltage-sensitive 2
  ENST ID: ENST00000430397
  CDS Start-End: 1-401
aaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaa

SEQ ID NO: 117347 - DNA, 2897 bp, Homo sapiens
  Payload ID: 2910
  Gene Symbol: CLCN2
  Gene Name: chloride channel, voltage-sensitive 2
  Uniprot ID: P51788
  ENST ID: ENST00000434054
  CDS Start-End: 125-2689
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggca

SEQ ID NO: 117348 - DNA, 3635 bp, Homo sapiens
  Payload ID: 2911
  Gene Symbol: CLCN3
  Gene Name: chloride channel, voltage-sensitive 3
  Uniprot ID: P51790
  ENST ID: ENST00000347613
  CDS Start-End: 555-3155
gtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggattgtcttggggatcatcacaaagaagaacatattagagcatctcgagcaactaaagcagcacgtcgaacccttggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctct

SEQ ID NO: 117349 - DNA, 3208 bp, Homo sapiens
  Payload ID: 2911
  Gene Symbol: CLCN3
  Gene Name: chloride channel, voltage-sensitive 3
  Uniprot ID: P51790
  ENST ID: ENST00000360642
  CDS Start-End: 552-2927
acgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagc

SEQ ID NO: 117350 - DNA, 735 bp, Homo sapiens
  Payload ID: 2911
  Gene Symbol: CLCN3
  Gene Name: chloride channel, voltage-sensitive 3
  ENST ID: ENST00000515420
  CDS Start-End: 1-735
ctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactg

SEQ ID NO: 117351 - DNA, 5592 bp, Homo sapiens
  Payload ID: 2911
  Gene Symbol: CLCN3
  Gene Name: chloride channel, voltage-sensitive 3
  ENST ID: ENST00000504131
  CDS Start-End: 1-2406
atggtgaagcttcctataggagagtctcactatgttgtccaggctggtctccaactcctgggctcaagcaaccctcctgccttggcctcccaagtagctgagattacaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgac

SEQ ID NO: 117352 - DNA, 6692 bp, Homo sapiens
  Payload ID: 2911
  Gene Symbol: CLCN3
  Gene Name: chloride channel, voltage-sensitive 3
  Uniprot ID: P51790
  ENST ID: ENST00000513761
  CDS Start-End: 560-3016
gtgacgtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaa

SEQ ID NO: 117353 - DNA, 582 bp, Homo sapiens
  Payload ID: 2911
  Gene Symbol: CLCN3
  Gene Name: chloride channel, voltage-sensitive 3
  ENST ID: ENST00000511092
  CDS Start-End: 62-582
agcgcgtggaaggcggcacgcagcggaggcggctgggaaggagcaataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttg

SEQ ID NO: 117354 - DNA, 2485 bp, Homo sapiens
  Payload ID: 2911
  Gene Symbol: CLCN3
  Gene Name: chloride channel, voltage-sensitive 3
  ENST ID: ENST00000507875
  CDS Start-End: 309-2485
agttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaag

SEQ ID NO: 117355 - DNA, 563 bp, Homo sapiens
  Payload ID: 2911
  Gene Symbol: CLCN3
  Gene Name: chloride channel, voltage-sensitive 3
  ENST ID: ENST00000512813
  CDS Start-End: 148-563
tttcgggctcctgactcctgccgcttctcttccccttccgtgggtcagggccggtccggtccggaacctgcagcccctttcccagtgttctagttcgcccgtgacccggaataatgagcaaggagggtgtgataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatc

SEQ ID NO: 117356 - DNA, 5874 bp, Homo sapiens
  Payload ID: 2911
  Gene Symbol: CLCN3
  Gene Name: chloride channel, voltage-sensitive 3
  ENST ID: ENST00000613795
  CDS Start-End: 309-2684
agttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatg

SEQ ID NO: 117357 - DNA, 2418 bp, Homo sapiens
  Payload ID: 2912
  Gene Symbol: CLCN4
  Gene Name: chloride channel, voltage-sensitive 4
  ENST ID: ENST00000380829
  CDS Start-End: 116-2305
ccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaa

SEQ ID NO: 117358 - DNA, 6750 bp, Homo sapiens
  Payload ID: 2912
  Gene Symbol: CLCN4
  Gene Name: chloride channel, voltage-sensitive 4
  Uniprot ID: P51793
  ENST ID: ENST00000380833
  CDS Start-End: 392-2674
atttgcctctggcaggaaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaa

SEQ ID NO: 117359 - DNA, 487 bp, Homo sapiens
  Payload ID: 2912
  Gene Symbol: CLCN4
  Gene Name: chloride channel, voltage-sensitive 4
  ENST ID: ENST00000454850
  CDS Start-End: 32-487
ggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgctttcagctgcagcggctgct

SEQ ID NO: 117360 - DNA, 6534 bp, Homo sapiens
  Payload ID: 2912
  Gene Symbol: CLCN4
  Gene Name: chloride channel, voltage-sensitive 4
  Uniprot ID: P51793
  ENST ID: ENST00000421085
  CDS Start-End: 458-2458
tcccagccggcctccggggccctccgggctgaaatcgacatttgcctctggcaggaaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaa

SEQ ID NO: 117361 - DNA, 3177 bp, Homo sapiens
  Payload ID: 2913
  Gene Symbol: CLCN5
  Gene Name: chloride channel, voltage-sensitive 5
  Uniprot ID: P51795
  ENST ID: ENST00000307367
  CDS Start-End: 292-2532
tgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaattta

SEQ ID NO: 117362 - DNA, 10108 bp, Homo sapiens
  Payload ID: 2913
  Gene Symbol: CLCN5
  Gene Name: chloride channel, voltage-sensitive 5
  Uniprot ID: P51795
  ENST ID: ENST00000376088
  CDS Start-End: 642-3092
gtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctg

SEQ ID NO: 117363 - DNA, 3046 bp, Homo sapiens
  Payload ID: 2913
  Gene Symbol: CLCN5
  Gene Name: chloride channel, voltage-sensitive 5
  Uniprot ID: P51795
  ENST ID: ENST00000376091
  CDS Start-End: 333-2783
gtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattat

SEQ ID NO: 117364 - DNA, 2660 bp, Homo sapiens
  Payload ID: 2913
  Gene Symbol: CLCN5
  Gene Name: chloride channel, voltage-sensitive 5
  Uniprot ID: P51795
  ENST ID: ENST00000376108
  CDS Start-End: 233-2473
gggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaa

SEQ ID NO: 117365 - DNA, 449 bp, Homo sapiens
  Payload ID: 2913
  Gene Symbol: CLCN5
  Gene Name: chloride channel, voltage-sensitive 5
  ENST ID: ENST00000482218
  CDS Start-End: 208-402
cagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaatttta

SEQ ID NO: 117366 - DNA, 5583 bp, Homo sapiens
  Payload ID: 2914
  Gene Symbol: CLCN6
  Gene Name: chloride channel, voltage-sensitive 6
  Uniprot ID: P51797
  ENST ID: ENST00000346436
  CDS Start-End: 53-2662
ctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctccttta

SEQ ID NO: 117367 - DNA, 5631 bp, Homo sapiens
  Payload ID: 2914
  Gene Symbol: CLCN6
  Gene Name: chloride channel, voltage-sensitive 6
  Uniprot ID: P51797
  ENST ID: ENST00000312413
  CDS Start-End: 168-2711
atcgtcatgtgacgcgagtcctcgccccacccgtctgcagccactcctggtctcagtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctccttt

SEQ ID NO: 117368 - DNA, 2922 bp, Homo sapiens
  Payload ID: 2914
  Gene Symbol: CLCN6
  Gene Name: chloride channel, voltage-sensitive 6
  Uniprot ID: P51797
  ENST ID: ENST00000376496
  CDS Start-End: 4-2865
aagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaatta

SEQ ID NO: 117369 - DNA, 814 bp, Homo sapiens
  Payload ID: 2914
  Gene Symbol: CLCN6
  Gene Name: chloride channel, voltage-sensitive 6
  ENST ID: ENST00000376497
  CDS Start-End: 51-419
ggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccgtctcaaaaacaaacaaa

SEQ ID NO: 117370 - DNA, 3717 bp, Homo sapiens
  Payload ID: 2915
  Gene Symbol: CLCN7
  Gene Name: chloride channel, voltage-sensitive 7
  ENST ID: ENST00000262318
  CDS Start-End: 84-2789
gtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccaggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggcatgcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctc

SEQ ID NO: 117371 - DNA, 4720 bp, Homo sapiens
  Payload ID: 2915
  Gene Symbol: CLCN7
  Gene Name: chloride channel, voltage-sensitive 7
  Uniprot ID: P51798
  ENST ID: ENST00000382745
  CDS Start-End: 607-3024
attaggcgggaggaccctctggggctgcctggaggaagcctccactccgaccctcgcccgagtgcctactgcgagggcggatgcatgcttcgggacttctaatttcatccttcacgtctttagccgccgcctatggcaaggaaaggcctgccctcgcccctgcctccctcctcccttccccaccgcggctccgtcacgatcggcgcgggcgaccgggcctgggggagcccctccagccggctcctgccctcaggccccgggcgcttccctcgccccgactcccgggcccgaggtcccgggggcggccattcgcctcccaagcactcggcgctcagcccaacggggccgcctttgcagtcgcgtgggcagaacggggtcctcagggccgcggcgattctctagggcgggcggcgccacgacccgccgggagcgcggctcccaggagcccccgcgcgaccgggcctcggtggttgccgttgcaggtcacatggtcgccgtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagaaaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattca

SEQ ID NO: 117372 - DNA, 4151 bp, Homo sapiens
  Payload ID: 2915
  Gene Symbol: CLCN7
  Gene Name: chloride channel, voltage-sensitive 7
  Uniprot ID: P51798
  ENST ID: ENST00000448525
  CDS Start-End: 111-2456
gtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccaggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagaaaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattc

SEQ ID NO: 117373 - DNA, 533 bp, Homo sapiens
  Payload ID: 2915
  Gene Symbol: CLCN7
  Gene Name: chloride channel, voltage-sensitive 7
  ENST ID: ENST00000564568
  CDS Start-End: 178-533
agtgagaatgactgagcgcctttatctgccatctttctgtgtggggatcagtcccgactttcaggtgatcttgggagtgacgagtatttgtactcagtctcccttcgcaccgagttgaatttgcaatgtgcaggcaaacacaataagcagcaagtcagaggttggaatgcgttccgcatgtcaccctgcagcgtgcgtctgagcagtgttaagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcct

SEQ ID NO: 117374 - DNA, 1014 bp, Homo sapiens
  Payload ID: 2915
  Gene Symbol: CLCN7
  Gene Name: chloride channel, voltage-sensitive 7
  ENST ID: ENST00000569851
  CDS Start-End: 367-1014
gtgtttgggatgcgctgtggagcctggaggtcagccctgctgcgcacatgaacaggctttgaatttggctcatctctaggggagcccatgggaagctaggaccccattcctgaagggccccagccttcccctgcagacagactggagaggcggagtctagaggccaagacaccacctcttaggccaggcgtttgtgctctgagcatcggactcgccgatggcctcctgcaaggcctgtagcctccctgttgcccagttttcccgtctgcgaaaaagttaacgcatgcatagcgctgagcacggtgcctgtcacaaactacgctctgaagaaactcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaag

SEQ ID NO: 117375 - DNA, 2475 bp, Homo sapiens
  Payload ID: 2916
  Gene Symbol: CLCNKA
  Gene Name: chloride channel, voltage-sensitive Ka
  Uniprot ID: P51800
  ENST ID: ENST00000331433
  CDS Start-End: 20-2083
gaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccaga

SEQ ID NO: 117376 - DNA, 2581 bp, Homo sapiens
  Payload ID: 2916
  Gene Symbol: CLCNKA
  Gene Name: chloride channel, voltage-sensitive Ka
  Uniprot ID: P51800
  ENST ID: ENST00000375692
  CDS Start-End: 129-2189
gcctccacagttctggttggtttgtcaaggacgtttttaatctccatggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccaga

SEQ ID NO: 117377 - DNA, 1997 bp, Homo sapiens
  Payload ID: 2916
  Gene Symbol: CLCNKA
  Gene Name: chloride channel, voltage-sensitive Ka
  Uniprot ID: P51800
  ENST ID: ENST00000439316
  CDS Start-End: 58-1992
gaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccgg

SEQ ID NO: 117378 - DNA, 2129 bp, Homo sapiens
  Payload ID: 2917
  Gene Symbol: CLCNKB
  Gene Name: chloride channel, voltage-sensitive Kb
  Uniprot ID: P51801
  ENST ID: ENST00000375667
  CDS Start-End: 184-1737
aacattatacagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcagcgggctcctccccgcccagggcgcatgccctgccctcccctcctgtctgtccctgtccgggctgcaggagagcaggacagatgggtcagggaggaggtgacatggggagggggtcctacagtcacaggtgggtgggggtggagggcccacctgagatcagtgtcgcccccaggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggcgctggggggtctctgtggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccagttgctcagtgactggccatcacattaatgaatgatgagattggagtacactgtcaccaagggcaggcacagatgccttctggggttgtctggttcccagtgagaggctcctgagaaaaataaagctggttcccaga

SEQ ID NO: 117379 - DNA, 2567 bp, Homo sapiens
  Payload ID: 2917
  Gene Symbol: CLCNKB
  Gene Name: chloride channel, voltage-sensitive Kb
  Uniprot ID: P51801
  ENST ID: ENST00000375679
  CDS Start-End: 112-2175
ggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtccccgcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcaggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcgggaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggcgctggggggtctctgtggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccagttgctcagtgactggccatcacattaatgaatgatgagattggagtacactgtcaccaagggcaggcacagatgccttctggggttgtctggttcccagtgagaggctcctgagaaaaataaagctggttcccaga

SEQ ID NO: 117380 - DNA, 464 bp, Homo sapiens
  Payload ID: 2917
  Gene Symbol: CLCNKB
  Gene Name: chloride channel, voltage-sensitive Kb
  ENST ID: ENST00000431772
  CDS Start-End: 1-441
gcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagtgtctccaggacatcttggctgcaggctgccccacagaaccagtgaccctgaagctgtccccagagacttccctgcatgaggcacagatgccttctggggttgtctggttcccagtgagaggctcctgagaaaaataaagctggttcccaga

SEQ ID NO: 117381 - DNA, 1544 bp, Homo sapiens
  Payload ID: 2917
  Gene Symbol: CLCNKB
  Gene Name: chloride channel, voltage-sensitive Kb
  ENST ID: ENST00000619181
  CDS Start-End: 153-1544
attctaagtgttcgccataaaccctgggcccaggcgggaaaggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtccccgcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcaggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcgggaaagtgggccctttcgtgcacctgtctgtgatgatggctgcctacctgggccgtgtgcgcaccacgaccatcggggagcctgagaacaagagcaacaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccatcacattaatgaatgatgagattggagtacactgtcaccaagggcaggcacagatgccttctggggttgtctggttcccagtgagaggctcctga

SEQ ID NO: 117382 - DNA, 1127 bp, Homo sapiens
  Payload ID: 2918
  Gene Symbol: CLIC1
  Gene Name: chloride intracellular channel 1
  Uniprot ID: O00299
  ENST ID: ENST00000375779
  CDS Start-End: 141-866
ctccccaggttcagggcggggccggtcgggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117383 - DNA, 1560 bp, Homo sapiens
  Payload ID: 2918
  Gene Symbol: CLIC1
  Gene Name: chloride intracellular channel 1
  Uniprot ID: O00299
  ENST ID: ENST00000375780
  CDS Start-End: 574-1299
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117384 - DNA, 1254 bp, Homo sapiens
  Payload ID: 2918
  Gene Symbol: CLIC1
  Gene Name: chloride intracellular channel 1
  Uniprot ID: O00299
  ENST ID: ENST00000375784
  CDS Start-End: 268-993
caggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117385 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000383404
  CDS Start-End: 141-866

SEQ ID NO: 117386 - DNA, 1560 bp, Homo sapiens
  Payload ID: 2918
  Gene Symbol: CLIC1
  Gene Name: chloride intracellular channel 1
  Uniprot ID: O00299
  ENST ID: ENST00000383405
  CDS Start-End: 574-1299
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgaaccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117387 - DNA, 1197 bp, Homo sapiens
  Payload ID: 2918
  Gene Symbol: CLIC1
  Gene Name: chloride intracellular channel 1
  Uniprot ID: O00299
  ENST ID: ENST00000395892
  CDS Start-End: 211-936
ggatttgattggcgcagtgggaagcccgcgagaagaggtggaagcattcgaattacatcaaattctggcagagagaagtagttctgatcagaacactcacacccctactgggacatgcccataccccttcgcacttctacacacccctgaagacagagagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117388 - DNA, 1254 bp, Homo sapiens; identical to SEQ ID NO: 117384
  Payload ID: 2918
  Gene Symbol: CLIC1
  Gene Name: chloride intracellular channel 1
  Uniprot ID: O00299
  ENST ID: ENST00000400052
  CDS Start-End: 268-993

SEQ ID NO: 117389 - DNA, 1197 bp, Homo sapiens; identical to SEQ ID NO: 117387
  Payload ID: 2918
  Gene Symbol: CLIC1
  Gene Name: chloride intracellular channel 1
  Uniprot ID: O00299
  ENST ID: ENST00000400058
  CDS Start-End: 211-936

SEQ ID NO: 117390 - DNA, 1197 bp, Homo sapiens; identical to SEQ ID NO: 117387
  Payload ID: 2918
  Gene Symbol: CLIC1
  Gene Name: chloride intracellular channel 1
  Uniprot ID: O00299
  ENST ID: ENST00000433916
  CDS Start-End: 211-936

SEQ ID NO: 117391 - DNA, 1254 bp, Homo sapiens
  Payload ID: 2918
  Gene Symbol: CLIC1
  Gene Name: chloride intracellular channel 1
  Uniprot ID: O00299
  ENST ID: ENST00000457485
  CDS Start-End: 268-993
caggttcagggcggggccggtcggtgagtcagcggctctctgatccagccagggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117392 - DNA, 1560 bp, Homo sapiens; identical to SEQ ID NO: 117383
  Payload ID: 2918
  Gene Symbol: CLIC1
  Gene Name: chloride intracellular channel 1
  Uniprot ID: O00299
  ENST ID: ENST00000442045
  CDS Start-End: 574-1299

SEQ ID NO: 117393 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000434202
  CDS Start-End: 141-866

SEQ ID NO: 117394 - DNA, 1254 bp, Homo sapiens; identical to SEQ ID NO: 117384
  Payload ID: 2918
  Gene Symbol: CLIC1
  Gene Name: chloride intracellular channel 1
  Uniprot ID: O00299
  ENST ID: ENST00000425464
  CDS Start-End: 268-993

SEQ ID NO: 117395 - DNA, 1560 bp, Homo sapiens; identical to SEQ ID NO: 117383
  Payload ID: 2918
  Gene Symbol: CLIC1
  Gene Name: chloride intracellular channel 1
  Uniprot ID: O00299
  ENST ID: ENST00000438750
  CDS Start-End: 574-1299

SEQ ID NO: 117396 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000423143
  CDS Start-End: 141-866

SEQ ID NO: 117397 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000438708
  CDS Start-End: 141-866

SEQ ID NO: 117398 - DNA, 1254 bp, Homo sapiens; identical to SEQ ID NO: 117384
  Payload ID: 2918
  Gene Symbol: CLIC1
  Gene Name: chloride intracellular channel 1
  Uniprot ID: O00299
  ENST ID: ENST00000456863
  CDS Start-End: 268-993

SEQ ID NO: 117399 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000423055
  CDS Start-End: 141-866

SEQ ID NO: 117400 - DNA, 1254 bp, Homo sapiens; identical to SEQ ID NO: 117384
  Payload ID: 2918
  Gene Symbol: CLIC1
  Gene Name: chloride intracellular channel 1
  Uniprot ID: O00299
  ENST ID: ENST00000422167
  CDS Start-End: 268-993

SEQ ID NO: 117401 - DNA, 1254 bp, Homo sapiens; identical to SEQ ID NO: 117384
  Payload ID: 2918
  Gene Symbol: CLIC1
  Gene Name: chloride intracellular channel 1
  Uniprot ID: O00299
  ENST ID: ENST00000418285
  CDS Start-End: 268-993

SEQ ID NO: 117402 - DNA, 1560 bp, Homo sapiens; identical to SEQ ID NO: 117383
  Payload ID: 2918
  Gene Symbol: CLIC1
  Gene Name: chloride intracellular channel 1
  Uniprot ID: O00299
  ENST ID: ENST00000447369
  CDS Start-End: 574-1299

SEQ ID NO: 117403 - DNA, 1560 bp, Homo sapiens; identical to SEQ ID NO: 117383
  Payload ID: 2918
  Gene Symbol: CLIC1
  Gene Name: chloride intracellular channel 1
  Uniprot ID: O00299
  ENST ID: ENST00000431921
  CDS Start-End: 574-1299

SEQ ID NO: 117404 - DNA, 1197 bp, Homo sapiens
  Payload ID: 2918
  Gene Symbol: CLIC1
  Gene Name: chloride intracellular channel 1
  Uniprot ID: O00299
  ENST ID: ENST00000415179
  CDS Start-End: 211-936
ggatttgattggcgtagtgggaagcccgcgagaagaggtggaagcattcgaattacatcaaattctggcagagagaagtagttctgatcagaacactcacacccctactgggacatgcccataccccttcgcacttctacacacccctgaagacagagagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117405 - DNA, 1127 bp, Homo sapiens; identical to SEQ ID NO: 117382
  Payload ID: 2918
  Gene Symbol: CLIC1
  Gene Name: chloride intracellular channel 1
  Uniprot ID: O00299
  ENST ID: ENST00000423804
  CDS Start-End: 141-866

SEQ ID NO: 117406 - DNA, 1560 bp, Homo sapiens
  Payload ID: 2918
  Gene Symbol: CLIC1
  Gene Name: chloride intracellular channel 1
  Uniprot ID: O00299
  ENST ID: ENST00000420458
  CDS Start-End: 574-1299
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagactccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 117407 - DNA, 1197 bp, Homo sapiens; identical to SEQ ID NO: 117387
  Payload ID: 2918
  Gene Symbol: CLIC1
  Gene Name: chloride intracellular channel 1
  Uniprot ID: O00299
  ENST ID: ENST00000435242
  CDS Start-End: 211-936

SEQ ID NO: 117408 - DNA, 1197 bp, Homo sapiens; identical to SEQ ID NO: 117387
  Payload ID: 2918
  Gene Symbol: CLIC1
  Gene Name: chloride intracellular channel 1
  Uniprot ID: O00299
  ENST ID: ENST00000447338
  CDS Start-End: 211-936

SEQ ID NO: 117409 - DNA, 1197 bp, Homo sapiens; identical to SEQ ID NO: 117387
  Payload ID: 2918
  Gene Symbol: CLIC1
  Gene Name: chloride intracellular channel 1
  Uniprot ID: O00299
  ENST ID: ENST00000451546
  CDS Start-End: 211-936

SEQ ID NO: 117410 - DNA, 1098 bp, Homo sapiens
  Payload ID: 2918
  Gene Symbol: CLIC1
  Gene Name: chloride intracellular channel 1
  Uniprot ID: O00299
  ENST ID: ENST00000614982
  CDS Start-End: 114-839
ggtgagtcagcggctctctgatccagcccgggagaggaccgagctggaggagctgggtgtgggcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgc

SEQ ID NO: 117411 - DNA, 1098 bp, Homo sapiens; identical to SEQ ID NO: 117410
  Payload ID: 2918
  Gene Symbol: CLIC1
  Gene Name: chloride intracellular channel 1
  Uniprot ID: O00299
  ENST ID: ENST00000621055
  CDS Start-End: 114-839

SEQ ID NO: 117412 - DNA, 1098 bp, Homo sapiens; identical to SEQ ID NO: 117410
  Payload ID: 2918
  Gene Symbol: CLIC1
  Gene Name: chloride intracellular channel 1
  Uniprot ID: O00299
  ENST ID: ENST00000618288
  CDS Start-End: 114-839

SEQ ID NO: 117413 - DNA, 1098 bp, Homo sapiens; identical to SEQ ID NO: 117410
  Payload ID: 2918
  Gene Symbol: CLIC1
  Gene Name: chloride intracellular channel 1
  Uniprot ID: O00299
  ENST ID: ENST00000616760
  CDS Start-End: 114-839

SEQ ID NO: 117414 - DNA, 1098 bp, Homo sapiens
  Payload ID: 2918
  Gene Symbol: CLIC1
  Gene Name: chloride intracellular channel 1
  Uniprot ID: O00299
  ENST ID: ENST00000614673
  CDS Start-End: 114-839
ggtgagtcagcggctctctgatccagccagggagaggaccgagctggaggagctgggtgtgggcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgc

SEQ ID NO: 117415 - DNA, 1098 bp, Homo sapiens; identical to SEQ ID NO: 117410
  Payload ID: 2918
  Gene Symbol: CLIC1
  Gene Name: chloride intracellular channel 1
  Uniprot ID: O00299
  ENST ID: ENST00000619727
  CDS Start-End: 114-839

SEQ ID NO: 117416 - DNA, 1098 bp, Homo sapiens; identical to SEQ ID NO: 117410
  Payload ID: 2918
  Gene Symbol: CLIC1
  Gene Name: chloride intracellular channel 1
  Uniprot ID: O00299
  ENST ID: ENST00000622613
  CDS Start-End: 114-839

SEQ ID NO: 117417 - DNA, 629 bp, Homo sapiens
  Payload ID: 2919
  Gene Symbol: CLIC2
  Gene Name: chloride intracellular channel 2
  ENST ID: ENST00000321926
  CDS Start-End: 231-629
ggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 117418 - DNA, 2655 bp, Homo sapiens
  Payload ID: 2919
  Gene Symbol: CLIC2
  Gene Name: chloride intracellular channel 2
  Uniprot ID: O15247
  ENST ID: ENST00000369449
  CDS Start-End: 220-963
aacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagacaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggcattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaa

SEQ ID NO: 117419 - DNA, 1017 bp, Homo sapiens
  Payload ID: 2920
  Gene Symbol: CLIC3
  Gene Name: chloride intracellular channel 3
  Uniprot ID: O95833
  ENST ID: ENST00000494426
  CDS Start-End: 261-971
ggatctccgtgcacaccagactcaagtccagggcagccccccacaccattccgccaccctgaggtcacaccctcaggctcagacaccccggggccgggctggcgttgctcaggcagctggttctgcgcgctgggcagcttcatctgcccgcctaggtggctccacggggcgggcccctcggccagggagggcggggcgcacagggagacttaaagagctccccaggtccccacccgcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcggga

SEQ ID NO: 117420 - DNA, 4346 bp, Homo sapiens
  Payload ID: 2921
  Gene Symbol: CLIC4
  Gene Name: chloride intracellular channel 4
  Uniprot ID: Q9Y696
  ENST ID: ENST00000374379
  CDS Start-End: 198-959
aagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaagtg

SEQ ID NO: 117421 - DNA, 2723 bp, Homo sapiens
  Payload ID: 2921
  Gene Symbol: CLIC4
  Gene Name: chloride intracellular channel 4
  Uniprot ID: Q9Y696
  ENST ID: ENST00000488683
  CDS Start-End: 173-934
agagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatc

SEQ ID NO: 117422 - DNA, 6023 bp, Homo sapiens
  Payload ID: 2922
  Gene Symbol: CLIC5
  Gene Name: chloride intracellular channel 5
  Uniprot ID: Q9NZA1
  ENST ID: ENST00000185206
  CDS Start-End: 154-1386
attgttagagacctgtcattgatagcagttgctagttgctgccttttaagagctcgttgattcctctgcaaggtggtgcagcatcctctgtcccttcattcatttcagatctactcaggtctccctgtaaacagatctctcggatcaataagcatgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaatttttaagctaatatttcactcttttgtcattctccttaagtttcatctcctaaaaagcttacccagcctgagcttggggacctgtgcagaggaaactaagaaaaatgcactcatcaactccttctcccagtgaacgcccggtgagaaaatccatttgccacaggcccttaccttcaacaatcccccttctatagtgttcgctggtaaagggtgaggctcccaagtgctggaaagcccctggacttggctcatttctcagcaagggcaggatagcacgggtcctttccatagaaatatcaacaaattctaacccaagcaatccctggacctacctgcctccagggatctctgaagaaaaaaagtaacccattgatcaaatcagaggagaggaagcaggaggtctcctagagcccattgaggaagaggaactttctcagtaggacactttataagcctgagaaagctttgaaaaggcggaatgagttgattcatttccacctcaaaaggaacctttccaggtccccctggaaattgtgccctggagatgtttaacaaggagaactggtgaggaaagagtccttttttactgtagggaaaagccccaaactggcctcctgggggatgagggctgaaatgatcccgaaggccttttaattagtgtgaaatcctgctgtactcagaaatccttccccgaatttacagcacaggcaggatgacctaagaggcagtttacttccctgagacccacagttgggctgttctggaaacacatctgtgaatcatagccaattgccacagagaaaacagaaccaagcctccggtgaggccactccaccccagagaagtctgcagaattccaaggactcggattggatgttcagaattcagcaactggaaagtccttaaaaacaaacaggccaaaccaaatcaatattgctgtttctagatgtcccttctgtggttgagctagttttacagagataaatatattaagacaaggaggtgggggtgttatatgatcaatgatagccatttgaaagagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatattaatattaccttcctttttttttttgtttcaaaagagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattacaaaa

SEQ ID NO: 117423 - DNA, 2390 bp, Homo sapiens
  Payload ID: 2922
  Gene Symbol: CLIC5
  Gene Name: chloride intracellular channel 5
  Uniprot ID: Q9NZA1
  ENST ID: ENST00000339561
  CDS Start-End: 308-1063
cggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaa

SEQ ID NO: 117424 - DNA, 2051 bp, Homo sapiens
  Payload ID: 2922
  Gene Symbol: CLIC5
  Gene Name: chloride intracellular channel 5
  Uniprot ID: Q9NZA1
  ENST ID: ENST00000544153
  CDS Start-End: 348-965
attttgggcgcgttggcggcggcgggatcgctgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaaggaacaagtaccactgaaagggatgatataattccagctcagtcacactgtgtcagagtgatacaatgcaaagatcaggagacccgagttccggtcctgtatttgctgccaactagcagcatgagctgaggcacatcatttaatctttttggaattcatttttctcatgcctagaagaacagaagtggattgtattccttcttgccttcttttcctttcttctttccctccttctttccttttctcttgctcaaacatgtattcactaccactcaaaaaccatttgttgaacaaagcaaacaaatgaatctcccaagccttgggcttcatcctgtgatttcctcaattcccacctgccttaaattactcagtgaagccctgtccttggagaaaattcagtgggtggttaacccagagaagctggagatcaaaaagaagatggccaatgaaagaacaaaggccagcccttggcccctatctctttggatttctgctgatccagcttatcagatcccagaaacctggcaaacctctaaagttcacaaagagcgaaggggaagccaagtcaggcctccagtttggcttcggatgccaaaacttaatctgggctgtgggagctaactgttttcatatgaaagagcaaattcagaacatgagcatggaagtccctgcgaacgtcagatctccgtgtgcatccttacccccttgctgctttcatgctcactctcctcttgcgtggctcgctttcaggtttatctccatccctggaagcagagttgctctggcccaggctctccatgagagtttggcttgaacattcattgtctggccccctcctagttctcatctcccaaagtcaagccaatgtgtgaagaaatgaccagctcagcagccaaggcccagggtgcacaggtcttcgttgggagaggcatctgcaggcctttccttgctcactgggatccttgcctagcatagtgacgatgttcagccctggagacaaacaagaaggggaacaccaacatcaatagaagtatatatttacaaattgcatttctgctgtattgaaactaacattctgccctttaaaatcctgaaaataaaatttcagtatgaaatg

SEQ ID NO: 117425 - DNA, 3806 bp, Homo sapiens
  Payload ID: 2923
  Gene Symbol: CLIC6
  Gene Name: chloride intracellular channel 6
  Uniprot ID: Q96NY7
  ENST ID: ENST00000349499
  CDS Start-End: 1-2061
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 117426 - DNA, 3860 bp, Homo sapiens
  Payload ID: 2923
  Gene Symbol: CLIC6
  Gene Name: chloride intracellular channel 6
  Uniprot ID: Q96NY7
  ENST ID: ENST00000360731
  CDS Start-End: 1-2115
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaaacttactgcattaggctgttctcgcattgctataaagaaatacctgagagctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 117427 - DNA, 830 bp, Homo sapiens
  Payload ID: 2924
  Gene Symbol: CCK
  Gene Name: cholecystokinin
  Uniprot ID: P06307
  ENST ID: ENST00000334681
  CDS Start-End: 210-557
cacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 117428 - DNA, 1527 bp, Homo sapiens
  Payload ID: 2924
  Gene Symbol: CCK
  Gene Name: cholecystokinin
  Uniprot ID: P06307
  ENST ID: ENST00000396169
  CDS Start-End: 907-1254
ctggcgttgccacagtccctccattccagagggaattccagagcggaatacggattccgattttaaaataagcgcttctaaatctttctccttgcatctaagacgggtgggggaaagaaagggagaggagttgaggtcccaaggttcaaggcctggtgatctccaggtcccaggctgggcggcctcggtgcacggagagggcgaggggcgtgttgtggagccttggcaaggcgctgctcttcctcgcgcctcggtttgcggtctgtgaaatggggttggcagtgcctttgcagggacgcggcgaactcaagcaccagcaagcggactcgaactcaaagggtttcagggtgtagacgaccagagcgcactgaggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggagccacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 117429 - DNA, 747 bp, Homo sapiens
  Payload ID: 2924
  Gene Symbol: CCK
  Gene Name: cholecystokinin
  Uniprot ID: P06307
  ENST ID: ENST00000434608
  CDS Start-End: 128-475
gagaggcactctgcaaacacttcctcaaactttaggaaagcaaaaacattccttctgctcaacacggcagaaaacagggtctctgccccttggcgctgggtgaggagttcccaaagaccagccagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 117430 - DNA, 1720 bp, Homo sapiens
  Payload ID: 2925
  Gene Symbol: CCKAR
  Gene Name: cholecystokinin A receptor
  Uniprot ID: P32238
  ENST ID: ENST00000295589
  CDS Start-End: 196-1482
tacaaatgctggagtgagtgaggtgaactcaagtcgcctttaggaatggctgaaaaagcccacacctggaaatcactccctccctgctcctccacggcaggttgcatctgcgagacgcttcggtcattagaggaatgagccgggagtgagcaattcaccagctctccagcacttggtggaaagcagcaggcaaggatggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcctgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtgagatgtcccctgaccctccaccgcagaaggaaggcagggaggaggcagagaagaaagaacggaagaagagatcaggaagagaaggagcagagctgatggagaaggaaggctccatctccagtgggaactcttcaaggtctgcttttcatccttcatctggattccagagcactgctccagtggggccatgattggtttctaggcagttcaaagcaggatatgttaagtaacactcacca

SEQ ID NO: 117431 - DNA, 2121 bp, Homo sapiens
  Payload ID: 2926
  Gene Symbol: CCKBR
  Gene Name: cholecystokinin B receptor
  Uniprot ID: P32239
  ENST ID: ENST00000334619
  CDS Start-End: 194-1537
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 117432 - DNA, 1734 bp, Homo sapiens
  Payload ID: 2926
  Gene Symbol: CCKBR
  Gene Name: cholecystokinin B receptor
  ENST ID: ENST00000532715
  CDS Start-End: 124-1215
ggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtgg

SEQ ID NO: 117433 - DNA, 2138 bp, Homo sapiens
  Payload ID: 2926
  Gene Symbol: CCKBR
  Gene Name: cholecystokinin B receptor
  Uniprot ID: P32239
  ENST ID: ENST00000525462
  CDS Start-End: 4-1554
gccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggcgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 117434 - DNA, 463 bp, Homo sapiens
  Payload ID: 2926
  Gene Symbol: CCKBR
  Gene Name: cholecystokinin B receptor
  ENST ID: ENST00000531712
  CDS Start-End: 4-267
gccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagacagaacaaatacagatcttctaaacaccaggagaagaactgaactgtcccaatcttctgagtcgcctggtctgatgccagttttcctcatccccaggaagatgatgagatgatgctcacgggtagacttatcaaggcacttgtggatgtaccccagcagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgac

SEQ ID NO: 117435 - DNA, 792 bp, Homo sapiens
  Payload ID: 2926
  Gene Symbol: CCKBR
  Gene Name: cholecystokinin B receptor
  ENST ID: ENST00000525014
  CDS Start-End: 55-465
gcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggtgggtgagacaaccaccccacccccacttgccactctccccgcctaaagctcttgtggatgtaggggtcttccccggttggcagggaggggtgtgaggaagtcccactgatgcttgtgtagtgcaagtttcctaggtgactccttcctttctcttcccttgtttaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccg

SEQ ID NO: 117436 - DNA, 1686 bp, Homo sapiens
  Payload ID: 2927
  Gene Symbol: CH25H
  Gene Name: cholesterol 25-hydroxylase
  Uniprot ID: O95992
  ENST ID: ENST00000371852
  CDS Start-End: 23-841
agctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactcgtcctcgttcgcgctggcaacgcagtatatgagcgtctgggaactgttttctttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatcaaataagtattgacttccgtttcactggtattttgactgataaaaaagggaagagggagcgggcataccaagtgtccttctaagcctccatcagcctcaccatggaaagagaggaatctgggtgtagggtgttctgttgggggttgttagagaaaaggaggcaggagaaggggctctgtttgttgtgctctagcaatttcatggaggaaaaacacgctaatattcttaatgcttttcagctgatttctgtataacaggcaaatgataggattactctgtaaagtttcatagaaagattaacgctgagcagtcaa

SEQ ID NO: 117437 - DNA, 1791 bp, Homo sapiens
  Payload ID: 2928
  Gene Symbol: CETP
  Gene Name: cholesteryl ester transfer protein, plasma
  Uniprot ID: P11597
  ENST ID: ENST00000200676
  CDS Start-End: 131-1612
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaaga

SEQ ID NO: 117438 - DNA, 1537 bp, Homo sapiens
  Payload ID: 2928
  Gene Symbol: CETP
  Gene Name: cholesteryl ester transfer protein, plasma
  Uniprot ID: P11597
  ENST ID: ENST00000379780
  CDS Start-End: 58-1359
atatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaag

SEQ ID NO: 117439 - DNA, 1733 bp, Homo sapiens
  Payload ID: 2928
  Gene Symbol: CETP
  Gene Name: cholesteryl ester transfer protein, plasma
  ENST ID: ENST00000566128
  CDS Start-End: 268-1554
agtgcatctgtctgccctgccaggggtcttttcatggacacccactatgccaggagcctccctggcctgaagccagccctgaagccggctgccacactagcccagagagaggagtgccctgggagggagatgggctgagtggagctgtcatcaccccctcctgacctcgccttcaaggtcaagttctttgtgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaaga

SEQ ID NO: 117440 - DNA, 7665 bp, Homo sapiens
  Payload ID: 2929
  Gene Symbol: CHDH
  Gene Name: choline dehydrogenase
  Uniprot ID: Q8NE62
  ENST ID: ENST00000315251
  CDS Start-End: 439-2223
cgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggtgacagggtgagaccctgtctcaaaaaaaaaaaaaaaaaaaaaaacctgagatttttttggaccttattcaaggggagaggagtctggagggaatgccgcttggcttcactaccaaaggttttatgacttagcattttaaaaggttttccttttaccaagaaatgcagaaaccaagagcaaaccccacgtaccagatcactgattcctactgaagcagctagcccgagaaaggactctctcatactggtcttgggaaatgacttggcagcctgagccatcccagcagtggacaaggatggttaattcttattctgtagacgtccacaggaacagactaggatggaaaacacagttaagcacagccatgcaccctgtggctgtagaaatgcccctgtgtgaaagaaaaataaattcaagactggagttttggaggaaaaaaaatacaagtagcatttacaacagctctttgctctttaaatttcttaccattcaataaagtgatccagtcactcacatttgaactgagatgccttctccagactgttctgacaaggtaatgaaaataaaatgcacttggatttttccagacatccacatccaccgtcaagggctgggaagaaaagcattgttgcgtggaaacctgcagctatactaggcccagaataaggacgggaggaaattgggggattccaggctttgctcggatctgagaggattggggcggcttacagactggggcggggggggggggcgtccgacagccacaagttagttttctgagaaaaaccttcgagagaggcagcaggaagaaacccatcacacctctccttttaaaaatcttaagcagctcttgtttaatcttacctgtattttttaaaatttttgttcgaagagagggtcaagaaagaaaattctaaaccggccaagagacttatttctcctacggagggtccccacctgccccacagcagcagtccatggccatcagtcacctgggtctcggggctgcctgcaagagtgcagaaacaggagttcaggtgccagccccgtaacttggagggcctcgtgcagctttcctgctggagcgtgtgtggattcaggggcaggggatagtcctggaccaaccatgactgtgctgacccttcttctctggaacaggtatggatatggcagggtgacagtcacttagttctaccatctctgtgtcccatgggtgtgtcagtgtctgagaccatggtgggttcagtctggtggctgtattttaaaataagcaaaacgtcatatggtaagaggagcccattggtgatgctgctcaattgcacccaggcccttctttcactctcaaatacttagccatgttctacacaatcgcacaatttggccataaacaggaatgaggtttaaaagaaaagatggtaagtgtcacatgtccagaacctgagcgttcccctgccatgaagggagtctttcattcaccccaggaggagaggctgtcacctgaggaagccagcatgggggagaaaggcacttgctacaaagtggggtgcacagagggtacccccccatcttcagtctcatagggaattgggccccttggccaaaagcttgcagtacctaaaaacagagaaacgtgctttgcaaaaatggctcaaagagcacaacagaatgcgctgtccatgtgcccagtgctctcaggagccctgacctattgcagaagcctgtgttgaagccgctgcactagtagaaggcagctcctgatggaataggggataggggtgggctgtgtgggagccaagagcatctggcagcctgactggagatggtgagttcctgaagcaggagttgtaggcacccaaacatctagtctttctgcttgtagcgaaggttgcaggcatcatctccacgaattcaaatagattcttcttggctaggcatggtggctcacgcctgtaatcccagcactttgcaaggctgaggtgggtggatcacttgaggccaggagtttgagaccagcctggccaacatggtgaaaccccgtctctactaaaaatacaaaaattagctgggcatggtggtgcacgcctgtagtcccagctacttgggaggccgatacaggagaatcgcttgaacctgggtggcgcaggctgcagtgagccaagattgcaccactgcactccaccctgggtgacagagtgagactgtctcaaaaaaaaacaacaaaaaaacagattcttctccacccaaccatgtcccgccactcagaagtggtttcatgcttctactgataagccaacttaacatcagatccaatacagattttttaaagataaaataccatctctactggacctgtttagtggctcaggctgccctcacaggacatccctgagaccaccctgtcactcttgatgttggaaccagggcccaggcctgctcctcattgtctcctgccctcctagtccccaggagaggaaaagaaatactgttttagagaaataacattttcaacaaaacatccctggagtcagattttgagttggggtgggctaatcagggagtcggggctctctgcgtgatgtcagttctatggctaactggtttttctaaaccagccagctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgagaggtaacgtggccctcacagcccaccacgcctggccttcgcccaattctgaaacttcgtaggatagagctggaaagtgccacatggtgaagcgagatccagctgtctgggtggatgtcggagtccataggctgagcagagatggttcttagtgaggttctcgctgccagttgacggtgaaatcatagctgccatttacattttgtgagattatgaaaaacataagactaaagaaactaaatgtgttattcctgtggacacaaaaatgtgtgtttttcagatggggaggggaccaaaaaggaaaaacatttcatcttaaaactttcctaagacaagggaaaacaaaaaaccatgctctacaacttcaaatttttcttacaaagaaaaatttaatattcgatgagaggttgaaccaggcttaaagcagacatactaggaaatggtgcagcctgtaagaatgccagtttgtaagtactgactttggaaaagatcatcgcctctatcagacacttagggtcctggtctggcaattttggcctgatgtgatgccacaagacccaacagagagagacacagagtccaggataatgttgacagtggtgtagccctttaggagaaatggcgctccctgcggctggtattaggttaccattggcaccgaaggaaccaggaggataagaatatccataatttcagagctgccctggcacagtacctgccctgtcggaggctctcactggcaaatgacagctctgtgcaaggagcactcccaagtataaaaattattacacagttttattctgaagaacattttgcattttaataaaaaaggatttatgtcaggaaagagtcatttacaaaccttgaagtgtttttgcctggatcagagtaagaatgtcttaagaagaggtttgtaaggtcttcataacaaagtggtgtttgttatttacaaaaaaaaaaaaaaaaaaaaaaattaacaggttgtctgtatactattaaaaattttggaccaaaattgctacctatcatctatctttttgattgcagggaatccctgccaaggtaacctgacagtcggcctaattctgttgacagaaaatgaagccttgacggttctaattatccaaaagtgggttttcatcaggacgtacagtcagagtgtgagtgcattctaatgaaaacttcagccctcattcaattgcatataaaagccctcaaagagaacatacagtacagcagttttgtaaaaggcaacaatacgatttgtacagaccccgacactccaatcctatagatcaccacgttgctcctctgtccccagcaccccttatttcttaagcagcaccaccagtccccagaggacaagagcagctatatctcatccacctatgcatttctgcaccagcgatgcaaaaaacaccctgggtgggccacagagaaaaccgtaactatggatacccaaggggcagagcagccagctggacctgctctgtaattcacttacttacttaccagagggtggttcaagtcaaacaaacaaaaccaaagacagttgcaacccatggtggatccaaaggtacagtatcaaaatcatggaactcttgcccaaagaaaagactgcaaatagtcatctggtatatcttgtggaaagatgataggtttatagtgactcaaaatattttagaaaaatttctgtagtgtcaagttctttcaaacttaaaattttaaccccagaggattttcgctgaataaatgagaattggctcta

SEQ ID NO: 117441 - DNA, 631 bp, Homo sapiens
  Payload ID: 2929
  Gene Symbol: CHDH
  Gene Name: choline dehydrogenase
  ENST ID: ENST00000481668
  CDS Start-End: 167-631
tcggcacacaggctttgagacaaccagggtgcggagacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcc

SEQ ID NO: 117442 - DNA, 565 bp, Homo sapiens
  Payload ID: 2929
  Gene Symbol: CHDH
  Gene Name: choline dehydrogenase
  ENST ID: ENST00000467802
  CDS Start-End: 188-565
ggctagtccctctgagacgagcgagcaggcagccattcactaacatgcgttcattccacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgc

SEQ ID NO: 117443 - DNA, 2530 bp, Homo sapiens
  Payload ID: 2930
  Gene Symbol: CHKA
  Gene Name: choline kinase alpha
  Uniprot ID: P35790
  ENST ID: ENST00000265689
  CDS Start-End: 28-1401
ccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaataaaaacccaa

SEQ ID NO: 117444 - DNA, 1755 bp, Homo sapiens
  Payload ID: 2930
  Gene Symbol: CHKA
  Gene Name: choline kinase alpha
  Uniprot ID: P35790
  ENST ID: ENST00000356135
  CDS Start-End: 268-1587
gtggcgagcgcgagggcgggctgtgacgcggccggcgctcctcgtgcggcggcggcagaggagcgagtgcagcggccagcagcacatccccgctccacagtcgccgcagtcgccgcagccgccgccgccgccccgcgcgcccaaccgccgcggccccctgccccgccggcctgccagtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgttta

SEQ ID NO: 117445 - DNA, 1201 bp, Homo sapiens
  Payload ID: 2930
  Gene Symbol: CHKA
  Gene Name: choline kinase alpha
  ENST ID: ENST00000525155
  CDS Start-End: 1-495
attgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatgtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagtaagtgaagaagagtgggtggctcctgcctgtgctgtggaaggttttatttatcggttaccacttcattctccagcctgtagtgcccgactttgggttggaagctggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgta

SEQ ID NO: 117446 - DNA, 524 bp, Homo sapiens
  Payload ID: 2930
  Gene Symbol: CHKA
  Gene Name: choline kinase alpha
  ENST ID: ENST00000531341
  CDS Start-End: 56-524
ggtcggtggcgccgggtctgggggccgcgggacagtcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctca

SEQ ID NO: 117447 - DNA, 1638 bp, Homo sapiens
  Payload ID: 2931
  Gene Symbol: CHKB
  Gene Name: choline kinase beta
  Uniprot ID: Q9Y259
  ENST ID: ENST00000406938
  CDS Start-End: 219-1406
agagatctgcggaattcggccttcggaaagagcccccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgtcctggccc

SEQ ID NO: 117448 - DNA, 2458 bp, Homo sapiens
  Payload ID: 2932
  Gene Symbol: CHAT
  Gene Name: choline O-acetyltransferase
  Uniprot ID: P28329
  ENST ID: ENST00000337653
  CDS Start-End: 154-2400
aaatgctgagctaggggcaggaggcatgggcgggacagtgttctgtgcccccttctagagcctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 117449 - DNA, 2124 bp, Homo sapiens
  Payload ID: 2932
  Gene Symbol: CHAT
  Gene Name: choline O-acetyltransferase
  Uniprot ID: P28329
  ENST ID: ENST00000339797
  CDS Start-End: 174-2066
tcaacgccgctctggggacgcgtcaggcccagcgcacagcctgggcagctcagcctgtcagctgagcacgggcgcctcaaggggtgcggccctctcagaaggaaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 117450 - DNA, 2286 bp, Homo sapiens
  Payload ID: 2932
  Gene Symbol: CHAT
  Gene Name: choline O-acetyltransferase
  Uniprot ID: P28329
  ENST ID: ENST00000351556
  CDS Start-End: 336-2228
cccgccccgttgaggctttgagaaaggagtaggagccgagcattccggcagaggaagaaaaacggcccatcttttagagtccgacctctggaaattcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 117451 - DNA, 2114 bp, Homo sapiens
  Payload ID: 2932
  Gene Symbol: CHAT
  Gene Name: choline O-acetyltransferase
  Uniprot ID: P28329
  ENST ID: ENST00000395559
  CDS Start-End: 164-2056
cccgccccgttgaggctttgagaaaggagtaggagccgagcattccggcagaggaagaaaaacggcccatcttttagagtccgacctctggaaatgtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 117452 - DNA, 2528 bp, Homo sapiens
  Payload ID: 2932
  Gene Symbol: CHAT
  Gene Name: choline O-acetyltransferase
  Uniprot ID: P28329
  ENST ID: ENST00000395562
  CDS Start-End: 470-2470
aaatgctgagctaggggcaggaggcatgggcgggacagtgttctgtgcccccttctagagcctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcagtgagggaattcaccctactccacaccagagatgtggccggaatgcagagatgaagcactgagcacagtaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 117453 - DNA, 2528 bp, Homo sapiens; identical to SEQ ID NO: 117452
  Payload ID: 2932
  Gene Symbol: CHAT
  Gene Name: choline O-acetyltransferase
  ENST ID: ENST00000466590
  CDS Start-End: 154-492

SEQ ID NO: 117454 - DNA, 1585 bp, Homo sapiens
  Payload ID: 2933
  Gene Symbol: CHPT1
  Gene Name: choline phosphotransferase 1
  Uniprot ID: Q8WUD6
  ENST ID: ENST00000229266
  CDS Start-End: 236-1456
tccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaa

SEQ ID NO: 117455 - DNA, 1552 bp, Homo sapiens
  Payload ID: 2933
  Gene Symbol: CHPT1
  Gene Name: choline phosphotransferase 1
  ENST ID: ENST00000549128
  CDS Start-End: 171-1367
cggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctattctttcttcaaagagtcatcagaataacatggattgaagagacttccgaacacttgctatctcttgctgctgctgtttcatggaaggagatattaaacatttgtttaa

SEQ ID NO: 117456 - DNA, 1524 bp, Homo sapiens
  Payload ID: 2933
  Gene Symbol: CHPT1
  Gene Name: choline phosphotransferase 1
  Uniprot ID: Q8WUD6
  ENST ID: ENST00000552351
  CDS Start-End: 171-827
cggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgttttcttgaacagcagttgaccaacagattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaata

SEQ ID NO: 117457 - DNA, 580 bp, Homo sapiens
  Payload ID: 2933
  Gene Symbol: CHPT1
  Gene Name: choline phosphotransferase 1
  ENST ID: ENST00000552329
  CDS Start-End: 1-284
ttgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacggtgaagattcccatattaaggaatgtttttattttctgcctgcttggtgacctcagtagtttcataaaagttggctcttaggaggccactgtcataaattcaagcttttttgcaaaagaagaacatttctgaagaaacagttgtcctgttaccacaacattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtg

SEQ ID NO: 117458 - DNA, 624 bp, Homo sapiens
  Payload ID: 2933
  Gene Symbol: CHPT1
  Gene Name: choline phosphotransferase 1
  ENST ID: ENST00000546873
  CDS Start-End: 1-115
ctttagtgctttgtgcctgcaaatttcaagacaccttcatctaaatatattcaagactgcatgtcatcaagcacctgaacagggtctcgctgtcgcccaggctggagtacagtagtacgatttcagctcactgcaacctttgcctccagggctcaagtgatcctcccacctcagccttcccagtagctgggactacaggcacagtggctcacacctgtaatcccagcaccgtggaaggtcgaagcaggagtattgcttgagcccaggagttcaagacagcctggataacagtaagaccctgtctctacaaaaatataaacaaaattagtcaggtgtggtggagcacatctgtggtcacagctgctcaggaagctgaggtgagaggactgcttgagcctgtgaggttgacgctgcagtcagctgagatcacgccactgctctccagcctggggcaacagagtgagatcgtctcaaaagaaacaaacaaacaaaaaacacttttgaagacataaggtaggttaaaaaaatcctttgtaattagaaaatgtgtcacttttttagctaagagcaatataatcatctcaccctaatgactagactaggagcctcacctctggcctggac

SEQ ID NO: 117459 - DNA, 2001 bp, Homo sapiens
  Payload ID: 2933
  Gene Symbol: CHPT1
  Gene Name: choline phosphotransferase 1
  ENST ID: ENST00000549872
  CDS Start-End: 191-1387
agcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaa

SEQ ID NO: 117460 - DNA, 4342 bp, Homo sapiens
  Payload ID: 2933
  Gene Symbol: CHPT1
  Gene Name: choline phosphotransferase 1
  ENST ID: ENST00000552215
  CDS Start-End: 1-554
gcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgttttcttgaacagcagttgaccaacagattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatcaaaaaaaaaaaaaaggagtaatttgtgtactacatctgttttaggcaagaaaaaggtatattgaagaaaacagtgaaagatgatattccttaaaagcaaaaaaacatacttatgggaattaagtacacagaaaacactggagtacttattttgcctctaactaactattggtaaaacttcccaaataaggactttcttacaaggatgaatagtacttatgatttatattctaataatatatactttggcttaaaaggaaaatcctttacaaagttcaaaaatttaggaaataatgtcaaatattcgttaatggtggaagactaatttcttcctgtacaagtaggttgtcacaattagaaaaagtttatctgtaggcacctgtttttttaaaacttggaaaaccttattataactaagataagggtgagttatacaggcaaaaattagaatttaaaacatagaaaagcaggaggccaggcatggtggctcacacctgtaatcccagcactttgggaggccgaggcgggcagatcatttgaagtcaggagttcgagaccagcctggccaacatggcgaaaccccgtctctactaaaaatacaaaaataagctgggcgtggtggcaagtgcctgtagtcccagctacttgggaagctgaggcaggaaaatcgcttgaacctgggaggcggaggttgcagtgagctgagattactccactgcactccagctggggtgacagagtgagactccatctcaaaaaataaataaacgcagatgtgatatatataaaccataagaaattaggtatgttaatgatgtgctcttaatttaattgcagaccaagcccaatgaagtgacattatgtctttgtggcaatgacatattcacaaatccatgtcttaaaactgttatttatatattgttctattgctagtgatttaatgttcagaggttaatgattttagcaatttattccagaacacaaatttaaatgcatcttattgtcattagaatcggttgtacaacttaagtatatagaaaaggatgtacatgtaaaatagattttgtattccgttttttccttaaagaacataaccttctatacttggttttctaccttttgggattgatagagatacaatgaagccaaacctaaaattaaatcgtctttatttaattgacagtgttagagagaaaaattcactatcattactaaagagctgaaagcttaatacatattctttaggaatagttgctaactaactcataactatttagatttgacttaacagaaagggaggtcttacaatgaaacaggtttatgattaaagatgttacaattaaactattctaaagacttacaatatgcttcttagctaacgttataattgtatcatattacttaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaatccttattttttcaatttcaatatgatcacttacagtttccatcataatttttttttgcaacatagccatttcttttttaaattcattttgtgcaccagtaagtagattatcatgattcttctccaactcttccatactctaaaaacacaaaagacaagttaagttacaaaggaccacttttcatctcaggttctaaacttgtacaattaattttcaaaagtagtaatttttgaatattcaaatgctcatctatttgaaataaaaatattctaagtaatacatgaataccaaaatacctactaaaaaagaaaaaatataagacatgaataaaatgttataggaagtacaatgtagtatactttgcccacaatgggtttcctgaactgttaaggtcaagataaaaaagactggaagtcccacatcagtaaaaaccatttctattaagctttccaaatatcaagcaataatctacttatgactaatagtgtgccatgaattcactagagggaataaaataatctatagtacaacctctttcacattatgaaaaataaaaattatgtcttacgtc

SEQ ID NO: 117461 - DNA, 2198 bp, Homo sapiens
  Payload ID: 2934
  Gene Symbol: CEPT1
  Gene Name: choline/ethanolamine phosphotransferase 1
  Uniprot ID: Q9Y6K0
  ENST ID: ENST00000357172
  CDS Start-End: 156-1406
gtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 117462 - DNA, 2251 bp, Homo sapiens
  Payload ID: 2934
  Gene Symbol: CEPT1
  Gene Name: choline/ethanolamine phosphotransferase 1
  Uniprot ID: Q9Y6K0
  ENST ID: ENST00000545121
  CDS Start-End: 209-1459
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 117463 - DNA, 1966 bp, Homo sapiens
  Payload ID: 2934
  Gene Symbol: CEPT1
  Gene Name: choline/ethanolamine phosphotransferase 1
  ENST ID: ENST00000615636
  CDS Start-End: 39-881
aaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagcc

SEQ ID NO: 117464 - DNA, 2964 bp, Homo sapiens
  Payload ID: 2935
  Gene Symbol: CHRM1
  Gene Name: cholinergic receptor, muscarinic 1
  Uniprot ID: P11229
  ENST ID: ENST00000306960
  CDS Start-End: 543-1925
agtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggca

SEQ ID NO: 117465 - DNA, 2123 bp, Homo sapiens
  Payload ID: 2935
  Gene Symbol: CHRM1
  Gene Name: cholinergic receptor, muscarinic 1
  Uniprot ID: P11229
  ENST ID: ENST00000543973
  CDS Start-End: 761-2123
atgtgcaggggggagggcgtgtgtgcgagggaagcaggcatgtgaataccagggcatgtgtgttggggcatggtgcacaggggctgggggctctaaggttgggtggggggaggagcccaaggaaacagtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtgggcaccctgaaacccaccacccccgtccacctcagctcccccaagatggactgaatcaggctgctggccagatagagaagctagaagccaaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgca

SEQ ID NO: 117466 - DNA, 549 bp, Homo sapiens
  Payload ID: 2935
  Gene Symbol: CHRM1
  Gene Name: cholinergic receptor, muscarinic 1
  ENST ID: ENST00000536524
  CDS Start-End: 147-549
cggtggcaagaatcaggttccaattctctggaacctctggtgacttctctacctgccacctgccccaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtg

SEQ ID NO: 117467 - DNA, 1694 bp, Homo sapiens
  Payload ID: 2936
  Gene Symbol: CHRM2
  Gene Name: cholinergic receptor, muscarinic 2
  Uniprot ID: P08172
  ENST ID: ENST00000320658
  CDS Start-End: 294-1694
acagactagccaagtggctgagacgagtgtggggtgcgtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaa

SEQ ID NO: 117468 - DNA, 2571 bp, Homo sapiens
  Payload ID: 2936
  Gene Symbol: CHRM2
  Gene Name: cholinergic receptor, muscarinic 2
  Uniprot ID: P08172
  ENST ID: ENST00000401861
  CDS Start-End: 413-1813
gtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggttgtccaggctgatcttatactcctggcctcaagtgatcctcctgcctcagtctccaaaagcactgggaatacataggttgttagcgacatgagtacagggtctggatcttacccattcaagagtgtattctcagcacccaatgcctggcatatagtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctc

SEQ ID NO: 117469 - DNA, 5918 bp, Homo sapiens
  Payload ID: 2936
  Gene Symbol: CHRM2
  Gene Name: cholinergic receptor, muscarinic 2
  Uniprot ID: P08172
  ENST ID: ENST00000445907
  CDS Start-End: 529-1929
acacacgcacgaatacagacacgctctcctgctgtactaaaggcgccagggcgcaaagacctagggagcgcgcgcgggcacacacacacacacacacacacacacagacacacacacactcacacactccaggctgcgggttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccagatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctcctcactgtgtcctttgcattcgttggggatatcaaggtctataaggatttagtgcacttataatcctatatgcgaaatgtttaaaccaatctgattttctcctaaatagccttttatatcaacagaatatcctacctaaaacataaacctgtttaagaaaccatcgtcactgtaaagttgaggtttcatcaaattaaataatggactatctagttggaccaagtttattaaagtcaggtgaattttaagattaaaaaatagaagtttaggactttctatttcaacctgaatttgcctgacccatgtatgaaatgttaacttatagaaaatgaactcctgactttctcagcagaaaggaatgctgttttatttatttggaatcctaaacaggattaacatactcacatagcaccagtgatttctgggccagtccctagagaatagaaccttctatccaatgcctgctaaaggatgatattcaaattataaccaagtgaggatgtctgcaattatcctatgaccccatgaaaggggaaaaaacgatattttaaaaactattactgaaacaattacatattccatattcctcaaattgtcaattctccctaacattatttaacttcaaaattctcttatcaatagaattatagtaatctttgtgacagaaatgtagtggctaactaaatagaggccaaacgagcttacagaatctgacagaaggaggtaggtggctgttgccatgccacatctcaccatctaattctagaccataataatcatgtcaggaactattatctaagtggtggcattatatagaatcttgccacgtagagattttttatttggtcgtctaaataaatataggattaggattatacggattcacatacaactagttatttttatcctttatatttttcttacagtatttgctgtagttttccaatgagattttctaaaaatggctcaatcaatggaaatcaaattataaacgcatttgcaaatttcatattttggattttagatttatgatatcttgttcagtaataataatgttagttacatggtaaatttatcaatattagaccccagcacttaaaagaattattttgtatgattagcctcatagatgccacctcaacattttggagagttaaggaggaaaaaaagcatgagggaaaaaaaaaaccaaaaaacttataagttagtaagaagcaaattgccagcagtatttatatttgacttatccttcgtaaaaacaatttcctgtttaaataacttcagtcattacccccccaaagtaatcttccatatttaaagcattcatttatagagattcccttacctacagttacttcaacatgcacttttacattttaaattcatatttattttcatattgtttcttcaaatgaaggaatcagttgaacggaaataacgtcaagccagtgggctcctcgagtttctgaaaaccagagaattgactagccaagtatttccctttttaatgtattgtattattattatgtagatttggcttcagttgggaagaaccctttggcatccaggattcaggattcagggtctttttttgtttgctctaataatccaacgcaccatgaatcaagcttttagtctctgctgccattgtatccttccttttcctccctctgttattgatccttgccacagccactgcaacctcattgaaagagaaactgtcactttaaagaaagaaattgaagataggctgacaccatggaaactacgtcaaacagataagaaaaatggaaggaatactgaaaatgatagatgattggagagatatggagattatattcaaggatttttattaaccactgctggatttgtctatttcagtggctctcaaacagagacaattcccctctccccgaaaggggacacttagcaatgtgtaaagacatttttggttgccacactgggaggaatgctattggtatctagtgcatagaggctgggaatgctgctaaatagcctataatgctcaggacattttcccccaacccctttaaacaaatattatttggctcaaaatgtcaatagttccaagattgagaaattcttgtctactttaagggatttctaaagcttgcctcttattagtgggaaaataaccctgcattatttttagaatatcaatgcaaattcctcacctgttagaaaaaggtaatactcaccaaccatgtatcagaaaaacttttctcctgagtctggtgtatgtgtcagtcacagattgggaactcaggccacatctacatatcaaaaatcaccagactatgcatatcgcacatcttttttccagcatcttaatgttcaattatgattgccacagatctagtcaattgaggttgcagtagttggccatcaaaatatttgcagttgatatgatcagtttctactggagctgcaatttttcctttcaaaaaatattaagagcctctttcagaaacaatatcatttatcttctttgcatttactggaaaggtgtatctgtaaggtctttgttttttctctcctcatagcaataatgtagctatcccagagtgatattataagaagaggagattaagaatatggaaaaagtctgttcatttcttcgaaacaagaaatgattttccttttaccagttcatcattaatttaacgccagctcccaagtattagggcagagtaatcaatatgagaagccacaacgggtaagctttctgatttgaaatgtacaagctggatgtccaacatactcctgctctttgttcatttgcttttttgatcctgaagatctgacattgggagagatgggaattcaaaatgatggcaacaattactcagcaatgcagtctgtttttattttctcctacttagttcattgacagtttcctcctcgccccagtttgataatatccctttcaacaaccatagtaccggtgttgcaaatagtttaggaaagcacccaaagctggatgaaattgtgcaaagtgtattctcagcatgtatattcaataccatgcctcttaaaaatgcttctcttaaagggtgcacgctgtagcatgaaatgtgtgcatatttaatgtatcttcctggaatatgctatgtgctaaatatatatatattctataaataaaataataaaatgtacaatagaaatacatatttctgtatgcaaataaatatattatacacaaactcttaa

SEQ ID NO: 117470 - DNA, 2014 bp, Homo sapiens
  Payload ID: 2936
  Gene Symbol: CHRM2
  Gene Name: cholinergic receptor, muscarinic 2
  Uniprot ID: P08172
  ENST ID: ENST00000453373
  CDS Start-End: 238-1638
acagactagccaagtggctgagacgagtgtgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgt

SEQ ID NO: 117471 - DNA, 8780 bp, Homo sapiens
  Payload ID: 2937
  Gene Symbol: CHRM3
  Gene Name: cholinergic receptor, muscarinic 3
  Uniprot ID: P20309
  ENST ID: ENST00000255380
  CDS Start-End: 780-2552
gggcaatggcgggcgcccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcttccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaagaaaaaaaaaacatactactgaatataaagaaatttattctgaaatagactttacgtgtttttttcttaaagaggagaaaaatattgcttgacggcaattatatacccaaagtgatttgcctgggtcctttaattcccattagctttggaatctcagatgagcatagctgacccagttcccacattcttcccaaggatcccaaaagtgggaatccagaccccaagtggaacactgcaggcttacgaatctgtggttccaaaattatttcatacgttgcaaagctgaatcttcttgtcccaatagagcttcctgtcttttctttggtgtgttgttaaactctatttgtggacttgattcttgattcttgcaaagtactgttttgtgcagttcaagtttcgtacaaataaaaatacttaagtatatatatatgtgtgagttctgcacgcacacacatagtgtatataatatcatgggaaacactgaactggcaaattattcctgcaacatacgctttcagtactttggtaactgaagttctctaggatcctaatgcaacattaacgtgaaataagcccagtgtaatgtttttgaaaccagggctgttttccacagagagcagccaggccttcccagcaggtctgtgcagagcggacaggctcgtgagtcagctgagcgccgtggcttcgccagacttggtgttaagcaacctcctttgttgatgtctcaacagagctaaatcggggcccctctgagctcaaagaatgaaccacatccacacgtttgaatttaatcatctaaatctgaatgtttcagaacaaaatttctgctatctaaactgcttgaaactcaataatagtgtcacgtttgaatgtcatacacagcaatatatatatatgtgtatatatatatatatggcaaagcaaaaaaaaaaacatggtaagagagaatgaaggagaacattgtgtttgattcttgctgaatggcaccttctcaaagaaaatagggcttgcacctttgttaatcagctgtggccagtgctttctggtgttcattgtgtaaccttcacccaggaataggtgaggttttaggaagttacatgtcctctgaagaaagaattacactctgaaaagtaatgcttcaaattgatttccttaccttttgggaaaaaaaaaaaattgtttttttgcattctcccttgaattgaccaaaatgttaactgtttcatttggggaggggatggggtgctgccatcattgtcgttgttgttgctgctgtagctgttggggtttcttttcctgttgccggggctgtttggggagagggaggggagggaggtgggagggccgcggagatatcttccctttgtacagggcattcgtgttgtgaacccagagctgggtagaagctgcttttgtattcagtgtgaggtggtgtttacagacgactttgacaacagtagaagtgtactcagtggtgtctgtgtatctgaactatttaatttcgtgttatgtttatatgcagaaatatttatggatactacaccaagtgtttatttaatgttgataaatatgactcttcagtcgtcagccatggtgtcctttcaaagtgattctttaaggtccacttgagcaatgaatagagtatattggagctttcctgtggctaagaagaagaaacatgtcatcctgttggcatcaccaagcacctaactctttctaggtaataaaaagtcaacggtcacttcaacgtaaatgtttaaaaccactctttagttaaatctgatgggaactgaacaaagctccaccattgtgtctgaaatcattttacacagggaaaaaaaaaaacaatcagcataattgtaagaatgatttttttgggcccacattcaaccaaagaacaagaaagaaacagacgattttctaatatgtacacagcaaactacagaatgtcatattatccacctgtgaaacatctagtaagcaattgcatctatattttatttctcaagttggcctggcactaataaatatgtgaaagcttattcaagtgtcccagtacttcagcacttcccatccttttggaaactcctatcttgcctccctcccaaaagggctgtttcttttattaaaaaaaaaaaagaaatagaattaaatttgagaaaaggagaaaccctgaaatttaacagaactttgagagtcacttccaatctccttaaacatgattatctccttatccttgtccttttgtgatgctaataatagcagaaaaggaacaaatccaagactctaggtctcccttttttgttttactggttttattatagaattgtttttaagcctcttatggatgaaagctgcatttaaatactatctactgattttatagaaaggtatgtccatttcttgggtcactttcagagaaagaaaacaagcaaaataggttcttttgaatatgaataatttaaaagcataattgaagatgtagtgagtatttataattggaccttagttacacgtgcatttctcaaagggcttgtcattacaggagatattcagcacttacctaagatcaaaatgtcttcatcccaaattgggaatcgaattatttcatgccatatgcatgaggtttgcagacatttcaagattagccactttgcttgaaagaagaaaatgatcaaacctaaaataaactacacatggagaatctctctctctctctctgcctctctctctctctttctccctcttcttccttctctctctctcacaagcacacacacacacactcaatctccattctccaggcattgccagatggttaggagaagtgagctctctctggtcccctagatccctcggctctgctctcctttgcccatcagctccctgtggcctctatgctagtcctccctattctcctagtcaccctttgcctcttaagcccagccttgactctctacatatttttcatttctctttaccctttagtgtacaatagttgtagactctgacggaatgaaaacaaacaagaagcctaagcgttagaccctgctgtggctaaagatctagaaggcatatcagttttctctgtcaggcttcctacgttgccctcgtgcagggctcattgctctgcagagcgctggaagccccttcatgtatcgagagagaagctggagcacagagctctgatgcacagttggctgtttcagctctgactcagggaggaaagaaggatgccaaggctctgtcacagcggagaagtctaataccagagtggcacagagaaggattccagggatcagtcagggtgtcctgtacctatctgagtagagatgattcaaggatggggacatattccaggaaattgcacaatcttcccctggcagcttcagaggacgagtgaaaatagtgcagtatagtcaaagaagcaatgaatttaggatgaggaacctgaagtttctggaccagtttggtcactgcttagttacatgtccttaggaatgcttgtcacttaacctaaactttctgggttttatcctcattgctcaaactaagcaacaacaccgaagcttctctaatttgccttctgatgccaaatcggtcaaaactgaggtcagcagctaccatgacgaaagtaaaatggtatattgggtgaatgtttgaaaatttcagattttatattctgtaaagttatttacttactctatttcaacaccacaaaatcttgaaatttggaaggtaaccaaggaagctttgaaatttgttggcaaacccggagtagtatggtttcaaataccactccaacccagcacctgaggtcgggcaaactcacaaaatagagtttctaggtagcaggtgtttgctttggttttgcaatagcatttctcataacagaactgaaactgtatagattacaacactccaaagttatttttttttaacctaaagaaccctacttctagcacctcctctgaaagaatattttgctccaataccacgtgcaacaaacttatttagacagtatcaactctagcccttaataggttcaaggacaagtttactgcttcctttctacacgcttaagttacactctcttctcctgttctgatgactctaaatcttcagcctctcccagcattaatgtgtgagtcaacattgcagacctgagaaaggtttctagaatggtaacccaatgttctttagaactggagaattccattttccttttctggctttagtgttaatgtctgggaagggaggctcatgataagaaaataaaaatgagaaaagaagatctagttcataaaatgactataccccacgtaagtttgtaactgcacagtgttttgttgtacggctcagaaatgagcaagtgttagtattattaggcacacatcacgttcacagcttcgcgcagagacggatagtgtatttggatatatggaagtcatccaaatgcgttgctagaatatcaggcctatgtttgttctggtagaaccacagagactcacacaaagttctgaccctaccactctggtctgggctgagaccaccccaaaaaatcatctagagaatcaaaggggctcacatctcagttgcattctatttaaaagataaaggggccatactctccactgcaaagaagcattagtaaaacttcccgcacccaaattataatccggcaaccctagcttcagctaaaaagattatccccagaatctaaaagcttactattgttctttcttggagtccaaaatgcttagcagttctgcagttcacatacaaaactcaaaactctttttatcctgtattctgtgagttccttgatgatagtaattgggtcttattcatcactctgtatcctgtggctcacacagaatctggcaaattgcatatattcaataaatgttgaatatctaataacctccttattaatataacaaatattatcaacattctgtgcacatcaatgtcccatgctgctactgtagtcaggagttatttggctgggaagtggaaagtgttcacaaacatgatgcttatctaataaaatatcactgagcaataaggagaaatattttaaatagatttgaagttgtgaacaaataatttagagtccaaagaggaaaaagaaaattaactctgttttttatccctagaactcagaaactttactggattggtcaacaaagacaaactttttattgtataaaacagtagaattcatggaagggataattcttttggaacaggcttctcggttacttgccttagtaaaagaagtatctggagggcctggagagttcataaacatagttttctgtgcaagtgaagatctgtagtttggcttaaaaatccttgcatgtagttttgcttggcgtggaaagttattaggagacaatcctttatcctgttctgcaagcaatcaaacacatgatctcccttctagccattcctcatccagtacatgggcatttccagcctcctacatgtaacacttcaaacttcctctgggcgtctgcttagagctatgtgatggccacagtttgggcaaagcccttctttcttttaaatataggaactgttaccaagtttggtgcaggcttgaggaataattacataaaaatgggcttccacgatggtgaatcagcatgctgatttctcttggcaggaagctctcagggaaatgtctgtgaatcatttaaagatgctctctggtggatagagaaaccgcagtccaaaaacagatgggtgtatatttgctttgtaagcaaagggcatgtatcatactcgcatctaaaacagtgtccacatctttgccaaaggcactgaattttacctttttttattacctcgtggccagcacttcctcagtaggcatttcaggtgtgtcacaaaccatgttcatttttaatcttgaaaaagtcaatcgtctgtagtctgtactataaaatgatgcctgcaactttgtggtgaatattatccccaagttaacagtgaaataagtaaataaaactattattgaacaaaga

SEQ ID NO: 117472 - DNA, 587 bp, Homo sapiens
  Payload ID: 2937
  Gene Symbol: CHRM3
  Gene Name: cholinergic receptor, muscarinic 3
  ENST ID: ENST00000448020
  CDS Start-End: 259-587
ttttagtacggtattgttgcagctgacctgtatacgtaaggaattactgggtcatcagctctggggaatgtcttttgattatgaacacattttcagcatgtgtccactgaaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcct

SEQ ID NO: 117473 - DNA, 2294 bp, Homo sapiens
  Payload ID: 2937
  Gene Symbol: CHRM3
  Gene Name: cholinergic receptor, muscarinic 3
  Uniprot ID: P20309
  ENST ID: ENST00000615928
  CDS Start-End: 331-2103
ttgtttgttcttttctagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagc

SEQ ID NO: 117474 - DNA, 1511 bp, Homo sapiens
  Payload ID: 2938
  Gene Symbol: CHRM4
  Gene Name: cholinergic receptor, muscarinic 4
  Uniprot ID: P08173
  ENST ID: ENST00000433765
  CDS Start-End: 52-1491
tttctctccccttcctccccagacacggcctacccacccctggcaaccaacatggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctagg

SEQ ID NO: 117475 - DNA, 5410 bp, Homo sapiens
  Payload ID: 2939
  Gene Symbol: CHRM5
  Gene Name: cholinergic receptor, muscarinic 5
  Uniprot ID: P08912
  ENST ID: ENST00000383263
  CDS Start-End: 671-2269
atcagatcaactgctgttaccagataaaggcaaaactcacccttctggttctataatcctatccaaatggagtcttcatctaccgcatactatcctaactaatgctacaggattatcaggaatacagatataaagacactgcaagaaataaaacactggcaaaataaaacatgaaaggaaagtagagaaggcattttgggtctcgaagcttactatttccagccagagttcaaattactgagcttcaaacaaaccactgccaggaacctaggaaatcattctcagccttgcaacttaaaatatggtacatggatcagtagcatcaagaatactcaggagcttttcagaaatgtgcaattgtgaaatatggccaagatggcggattagaagcagcggcagcccgcagctctcatgcaaaggaatgaaaggtgtgagtgaatacagcgccttcaactgaaatatccaggttctcgctttgggactaattgggcaaacaacttgacccacagaaaacaaagaaaagcagggtggggtgacggcccacctgggagcagcacagagccaaaggaacccccacctccagccaagggaagcgatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctgaaaagtcaacaactcctctcgaaagaacaatgaccacagtcaacatcctctgaggatgagcaagctgattctggtttgtatattttcaaaaagaagacatctcattttgagtccttgaagatttttgtaaaggctcaagtttggttgccaaatggaaggggccatagctgcagcaattgctgacatattaaatgactcttgcctatgaccaaggccatttgatgccaggggagtttgccaatgaagtaaagggataggctcatggcccttcacaagaggaagcacactgggtaacaatgaacagtgactcagggaacttatgccccttctgtaggaaacagcagagaccaggtggaaaccttttcctgtggaaacctgtcatagaattttgtgcaatatgtatgtgtctatgaagctgtcttgtgccagtgagaaccagcaggagaatgtacaacagtgtcacttgttaacgagactgatattcaacaggcttctaagaatatgtatcttcataaactgatcactatctattatgcagctattatgtggtctatactatactgtggtttgttttcctgtccccacatctgagtgaaggtcttgctcttccctttcatatccaatgtcaattccttgtactcactgaacccatgctgatctccagggaaccatccttcctctcagaatccagagtctggaaggactgaaacctggtcatacccagtcctttcaaggggcctcttttctactaataaagatggatcaagtctccacagtcagttattttagtttttgccagtggaaattttttcttttatctaaacagatattgtgcattctattttgtgcccatttgaacccatttatttatgctctgttcttaggaagactaattgtgtaagagcccttcactggctgaagattttctccaggctgttgaattaaggttcttatattgttttcagagatcttgctttctaatctcttcacagggcaaacctgagcaaaatgtggaaaacagatttgcttttgaatttcttccagagcccttttgcagcctccaatttcccttgttcagatccccagttcacaccaagacgcaagcaggtcagctgtgctgcctccaagcagggggttgtggggtgaggtgggggtagaaagtctttttttataggtccttcaaatcagggcctaaaaatgacttctttattcctctccaaattcggtcacaaatgagaaggccagaaaagcacacttgagggtgcgatgaagctgaaaatgatctgaaagcttcatttttaaaaacaaagtgtaggtcatagtaatacataaaaataaaacagttgacatgcatgacagcatgaggattattaaaaaccacacttaattgaaatctctaagtgcgtataaacaaacggaatcaaaggacctttgtggacaaaagtccacaaagaagcagtagtgtggtacacagcaaggattttaaagatgaagcactcctgtcagacattatttaactcgttggttacatctgcagctggacttaaaaatcaccagacttcatgcgtcttagtgtaggccgggtccttttcagtctcatttgctaagaggatggaaaattagctggtttagttgtcctgggaattagatatgtacctgagtatgggagagcttcagcctaccactgaagagcatcatcagcctctcacaggatgtcccacggaggcttcagggtagtagaatctcaggcaggacgggactggtcccttataaagacttcacgttgacatgaaacatcttgtaagcagtgcatctgctgagcctttgtaaagggcaggttgacacctgcaaagaattcggtgggaacagtaattggctcagttctccagcacagaggctttcgggcctccgtgatgccaactgggtgtgacttcatgagcaaacctgctctaccagcgccagataaacagttgagtcttcgtttaaggctttgattcctgataaagatgaaaaccccttcatgagaataggcttttaagcccatgttgggcattcaccattcgcagttgagagtgaaacaagctaatttaaacaaaagaacacaaatcgggaaaggatgccatggagggcactcctcgcacactccgcacttgcttaggacttggccttttttgttcatcttttgtgaaattgattaagaagtgtattgctgggtgtggtggctgacacctgtaatcccagcactttgggaggctgaggcaagaggactgcttgaccctaggggctcaagaccagcctggcaacatagggagaccctgtctctacaaaaaaaattttaaatacctgggcattagcagggcatcgtagtgtgtgcctgtagacccagctacttcagaggttgaagcaggaggatcgcatgagcccaggagttagaggttgcagtgagctatgatcacactactgcattccagtctaagtgacagagcaagaccctgcctcaaaaaaaaaaagagagagagagaggtcaatgcttctttttttatcattggttttggaaagcagccagttttgcagactacctatgcctcttgacatagacaaaaaatatcccaaactactagggacaactagacttctatagaatagcggctttagtggggtcctcagaatgaatagacctaattgtaaactacagggacctgatgggtgggtgggaggcgcatggcctgacttgagatcttaggccttctatgcccccagtcttccaggctttgtctatagtaaaccatgtatgactttggctagttacctactggatgctgttactttgctatcattgtaatttgtttccccttggctgtgaatttgatgacttgtcagggaatctgttttccattcaatttttggttgaacaaagcattttgtcaatattctcagcttttgcttcgctcctttggtgaatgtcctttgaagacaatactgatgccagctctttgtaattgtgaaatctgtacccaaacctctggattagaatctccagttgtctactgtaaatactggaattacagcaaaggatatggggactgggctgcttttctgtattgtataagcactattctagatattaaagaaatttaaccgc

SEQ ID NO: 117476 - DNA, 572 bp, Homo sapiens
  Payload ID: 2939
  Gene Symbol: CHRM5
  Gene Name: cholinergic receptor, muscarinic 5
  ENST ID: ENST00000560035
  CDS Start-End: 507-572
cagataatgttttttaaagcagcttgatttggaagcgtgtgtaattctgaaatacgaacaagcagaacttttccagggggtcaaatgcatataggaacaaccaggatttctcattgctgaagcattcaatgaatctttaataagttctcaacactcagattgtttgtgatcagatcaactgctgttaccagataaaggcaaaactcacccttctggttctataatcctatccaaatggagtcttcatctaccgcatactatcctaactaatgctacaggattatcaggaatacagatataaagacactgcaagaaataaaacactggcaaaataaaacatgaaaggaaagtagagaaggcattttgggtctcgaagcttactatttccagccagagttcaaattactgagcttcaaacaaaccactgccagatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttg

SEQ ID NO: 117477 - DNA, 2687 bp, Homo sapiens
  Payload ID: 2939
  Gene Symbol: CHRM5
  Gene Name: cholinergic receptor, muscarinic 5
  Uniprot ID: P08912
  ENST ID: ENST00000557872
  CDS Start-End: 315-1913
agtggtacaagatgtggaggtggaagacagtgatattgtgtccggaatttattccttcttgtgggttctcggtctcactaacttcaagaatgaagccgcagaccgtcgcggtgtgttacagttcttaaagatggtgtgtccagagtttgttccttcagatgttcagatgtgtcgagtttcttccttccggtgggttcgtggtctccctgacttcagaagtgaagccacataccttcgcaatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctgaaaagtcaacaactcctctcgaaagaacaatgaccacagtcaacatcctctgaggatgagcaagctgattctggtttgtatattttcaaaaagaagacatctcattttgagtccttgaagatttttgtaaaggctcaagtttggttgccaaatggaaggggccatagctgcagcaattgctgacatattaaatgactcttgcctatgaccaaggccatttgatgccaggggagtttgccaatgaagtaaagggataggctcatggcccttcacaagaggaagcacactgggtaacaatgaacagtgactcagggaacttatgccccttctgtaggaaacagcagagaccaggtggaaaccttttcctgtggaaacctgtcatagaattttgtgcaatatgtatgtgtctatgaagctgtcttgtgccagtgagaaccagcaggagaatgtacaacagtgtcacttgttaacgagactgatattcaacaggcttctaagaatatgtatcttcataaactgatcactatctattatgcagctattatgtggtctatactatactgtggtttgttttcctgtccccacatctgagtgaaggtcttgctcttccctttcatatccaatgtcaattccttgtactcactgaacccatgctgatctccagggaaccatccttcctctcagaatccagagtctggaaggactgaaacctggtcatacccagtcctttcaaggggcctcttttctactaataaagatggatcaagtctccaca

SEQ ID NO: 117478 - DNA, 2071 bp, Homo sapiens
  Payload ID: 2940
  Gene Symbol: CHRNA7
  Gene Name: Cholinergic receptor, nicotinic alpha 7
  ENST ID: ENST00000632335
  CDS Start-End: 105-1613
ggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaagg

SEQ ID NO: 117479 - DNA, 1980 bp, Homo sapiens
  Payload ID: 2941
  Gene Symbol: CHRNA1
  Gene Name: cholinergic receptor, nicotinic, alpha 1 (muscle)
  Uniprot ID: P02708
  ENST ID: ENST00000261007
  CDS Start-End: 68-1516
cagccagagtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagggtgacatggtagatctgccacgccccagctgcgtgactttgggagttcctttgttttctcatctgcagaatgagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataa

SEQ ID NO: 117480 - DNA, 1984 bp, Homo sapiens
  Payload ID: 2941
  Gene Symbol: CHRNA1
  Gene Name: cholinergic receptor, nicotinic, alpha 1 (muscle)
  Uniprot ID: P02708
  ENST ID: ENST00000348749
  CDS Start-End: 79-1452
agacaagcacccagccagagtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataaggcatttgatttggagagagaggaagcagtagaaatgaaataaactaaaatgcaaactgcatcaaaaa

SEQ ID NO: 117481 - DNA, 1466 bp, Homo sapiens
  Payload ID: 2941
  Gene Symbol: CHRNA1
  Gene Name: cholinergic receptor, nicotinic, alpha 1 (muscle)
  ENST ID: ENST00000409219
  CDS Start-End: 19-1152
cacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattg

SEQ ID NO: 117482 - DNA, 1585 bp, Homo sapiens
  Payload ID: 2941
  Gene Symbol: CHRNA1
  Gene Name: cholinergic receptor, nicotinic, alpha 1 (muscle)
  ENST ID: ENST00000409323
  CDS Start-End: 60-869
gtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggtgggtgtggttgccatgactgctgctgctgacgctgatgggtctcgtgctgctattttggggaagccagaaataatcatgtgctaacaaacaggcagatcgacccgaaccatcatcattaggagggtgcatttgctgagtgggcgtgcgcagtggtgagagtcactgtgagtggagctcacagctggggcagacaccccgagcggcagggagttgaacatgaccctagagatgcacagtgtagcttaggctggttaaagtacattaaccaccaatacctatttgctgaataccaactgtgtgcccagaagtgtactgggtaaggcatgtgatcccagacacttctcatgccacttccacgatgaagtcactttctatgtactgactaatcctggtcttgcccctttacccactgctcaccacttgaaaatagattttgcatatctttttttccagatggtggcatcttcacacacaagaccctacttcccaagtggctgttctttctcacatatcagcctagacaacttacttacctcctactgagtaatcctatctgtgacataattttatcaaacaataacaatccaccagaaaggaggaaagggtacccatctgcctgccagcaagtcactattcataaacaacttatggcagacaagtttgaaaaaaagaaagatgctacagacagacctcaagcttatgacaggtagcaatttttatcaaaatgactttaaaaaaaaaaaaa

SEQ ID NO: 117483 - DNA, 1460 bp, Homo sapiens
  Payload ID: 2941
  Gene Symbol: CHRNA1
  Gene Name: cholinergic receptor, nicotinic, alpha 1 (muscle)
  ENST ID: ENST00000409542
  CDS Start-End: 19-1146
cacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattg

SEQ ID NO: 117484 - DNA, 1596 bp, Homo sapiens
  Payload ID: 2941
  Gene Symbol: CHRNA1
  Gene Name: cholinergic receptor, nicotinic, alpha 1 (muscle)
  ENST ID: ENST00000435083
  CDS Start-End: 19-264
cacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagtgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattg

SEQ ID NO: 117485 - DNA, 1945 bp, Homo sapiens
  Payload ID: 2942
  Gene Symbol: CHRNA10
  Gene Name: cholinergic receptor, nicotinic, alpha 10 (neuronal)
  Uniprot ID: Q9GZZ6
  ENST ID: ENST00000250699
  CDS Start-End: 73-1425
taattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaaagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttggccccaaatccctgactcaataaagtaagcgtgtacctagca

SEQ ID NO: 117486 - DNA, 1541 bp, Homo sapiens
  Payload ID: 2942
  Gene Symbol: CHRNA10
  Gene Name: cholinergic receptor, nicotinic, alpha 10 (neuronal)
  ENST ID: ENST00000526599
  CDS Start-End: 56-346
tggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggtgcgttgtggtggtggtacagctgtggagtcttacctgtcacagtgtcaagaaatgaaggggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaaagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtg

SEQ ID NO: 117487 - DNA, 1474 bp, Homo sapiens
  Payload ID: 2942
  Gene Symbol: CHRNA10
  Gene Name: cholinergic receptor, nicotinic, alpha 10 (neuronal)
  ENST ID: ENST00000534359
  CDS Start-End: 598-969
tggccaggaggcctcacatccagagacctgcccccgctcttgcagtgccagggccatggggctccggagccaccacctcagcctgggccttctgcttctgtttctactccctgcagtgccctgagacctgtggcagacacagaccagactctgaatgtgaccctggaggtgacactgtcccagatcatcgacatggtgcgttgtggtggtggtacagctgtggagtcttacctgtcacagtgtcaagaaatgaaggggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaaagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtg

SEQ ID NO: 117488 - DNA, 1735 bp, Homo sapiens
  Payload ID: 2943
  Gene Symbol: CHRNA2
  Gene Name: cholinergic receptor, nicotinic, alpha 2 (neuronal)
  Uniprot ID: Q15822
  ENST ID: ENST00000240132
  CDS Start-End: 165-1709
aatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctccca

SEQ ID NO: 117489 - DNA, 4067 bp, Homo sapiens
  Payload ID: 2943
  Gene Symbol: CHRNA2
  Gene Name: cholinergic receptor, nicotinic, alpha 2 (neuronal)
  Uniprot ID: Q15822
  ENST ID: ENST00000407991
  CDS Start-End: 610-2199
agagaggctgtgtgtgtgtgtgtgtgtgtgtatgtgtgtgtgtgtgtgagagagagagagaacagcgtgagcctgtgtgcttgtgtgctgagccctcatcccctcctggggccaggcttgggtttcacctgcagaatcgcttgtgctgggctgcctgggctgtcctcagtggcacctgcatgaagccgttctggctgccagagctggacagccccaggaaaacccacctctctgcagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcacccccgctgaccatcttttgaccgtctctgctacagctgcctctggtgtcccctttgggatgagcaggtgcctctccgcggagtctggacactgacccagggattgcaggcttccatccagcttaacgttattgtaccagggctgacagcctgctgggtgcaaagccctgttttggatacggaggagctggggaagctctgcagaaggtcgcaatagtgtggtgaccaagtggggcagagtaagattctcctggaggagcagtgcagaccctaagtgacagaagggtcaaccagggggacagtggggccagggtgacgaggaagggaatgcagacctcaaaggaggggccgtgggggcaaaggggagggttcttggatgtggaagggctttgaacaatgtttagatttggagatgagcccaaagtgccagggagaacagccaggtgaggtgggaggttggagagccaggtgaggtctctgtaagtcaggctggggttgaagtttggagtctgtccgagtttgcagggtgctgagctgtatggtccagcaggggagtaataagggctcttctggaaggggaggaagcgggaggcagggcctgcacctgatgtggaggtacagggcagatcttccctaccggggagggatggatggttggatacaggtggctgggctattccatccatctggaagcacatttgagcctccaggcttctccttgacgtcattcctctccttccttgctgcaaaatggctctgcaccagccggcccccaggaggtctggcagagctgagagccatggcctgcaggggctccatatgtccctacgcgtgcagcaggcaaacaagaaagaccatcctgagctgctcctgacccacctcaaactcatctcatttggcctgtcctccctcccttcacccctccttccctccccaggaaccctgttccctgtgcctggctccatcaggaggaggcctcacttgggagttgaagatctttgcctttagttcctttgattctgaacttctcaaaggcaggtactctgcctgttatttttcccacccccagcacctagcacagcgccgggtgagtggggtcagcacttagggcgtttgttctgagtggttgaggggagcaagctggattgtttgggccccaggactgttgtgtagatggcaaagctgtggtcccgtcccttatcagcctgcctcgtctctcccagagccccgaggtgtgttgacctgctctgaacccttcagagcagcctgtgtgtgcaccttggaatgcaatgcaccaccccacagtctgaggctgcacccaggatcccaggccgagctgctgctcctgggatcgggcaacagacctccccccaactctgtccagactggagggtgggacattggcagctaacagatgtgggcatcgggttctcgggacagcatggaggctccaggcaggaagccgagcagggcgagcttccagtttccttttggtcctaggggtcccctccttccaaaccccaaaatgtctctccctgacactctcaggggaaaccagcctggctgtgacgccctggcccaggccctgccatgcctcacttctctcccacaacccccctgctcatggcacatctggtctctggctcctgtctactcgtgtgcatgcagcccccagcgccccctctcctcccacttgctctccggaggcctcagagctctcgggtccaggctcccagacccactctcctgagacagtgatgttcacttctgttatccatgtctcccatccatcttgcatgtgaataaagagattaaataaagctgcacctactgctga

SEQ ID NO: 117490 - DNA, 2497 bp, Homo sapiens
  Payload ID: 2943
  Gene Symbol: CHRNA2
  Gene Name: cholinergic receptor, nicotinic, alpha 2 (neuronal)
  Uniprot ID: Q15822
  ENST ID: ENST00000520933
  CDS Start-End: 443-1966
cttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcagatgagcaaactgaggctcagtgaggctgagtggctctgatttgatggcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcacccccgctgaccatcttttgaccgtctctgctacagctgcctctggtgtcccctttgggatgagcaggtgcctctccgcggagtctggacactgacccagggattgcaggcttccatccagcttaacgttattgtaccagggctgacagcctgctgggtgcaaagccctgttttggatacggaggagctggggaagctctgcagaaggtcgcaatagtgtggtgaccaagtggggcagagtaagattctcctggaggagcagtgcagaccctaagtgacagaagggtcaaccagggggacagtggggccagggtgacgaggaagggaatgcagacctcaaaggaggggccgtgggggcaaaggggagggttcttggatgtggaagggctttgaacaatgtttagatttggagatgagcccaaagtgccagggagaacagccaggtgaggtgggaggttggagagccaggtgaggtctctgtaagtcaggctggggttgaa

SEQ ID NO: 117491 - DNA, 576 bp, Homo sapiens
  Payload ID: 2943
  Gene Symbol: CHRNA2
  Gene Name: cholinergic receptor, nicotinic, alpha 2 (neuronal)
  ENST ID: ENST00000521921
  CDS Start-End: 427-576
aatttgactattctaggaacatcctataaaaggaatcataatgtctttgtctttttgtaactggcttattttacatagcataatgccctcaagtttcatccacgttgtagcatgggtcagaatttctgtcctttttaaggacaaataatattccactgtatggatagaccacatttgttcaaccattcatctgtcgctggataccggagttgcttccactttttacacagctgattgatgaactgcactgcattctgatggaagagtggagtcaaatctacacagtttgggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccg

SEQ ID NO: 117492 - DNA, 576 bp, Homo sapiens
  Payload ID: 2943
  Gene Symbol: CHRNA2
  Gene Name: cholinergic receptor, nicotinic, alpha 2 (neuronal)
  ENST ID: ENST00000524096
  CDS Start-End: 252-576
gttaatagatggggtgatgtcaagatcacagtgggccaggattcgccatgcacaggaggagacaggagtactcatctgatactagagaaaaggaggcttcaccggaaaatcaaaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacg

SEQ ID NO: 117493 - DNA, 2515 bp, Homo sapiens
  Payload ID: 2943
  Gene Symbol: CHRNA2
  Gene Name: cholinergic receptor, nicotinic, alpha 2 (neuronal)
  ENST ID: ENST00000523695
  CDS Start-End: 528-992
gtgtgctgagccctcatcccctcctggggccaggcttgggtttcacctgcagaatcgcttgtgctgggctgcctgggctgtcctcagtggcacctgcatgaagccgttctggctgccagagctggacagccccaggaaaacccacctctctgcagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaacagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcacccccgctgaccatcttttgaccgtctctgctacagctgcctctggtgtcccctttgggatgagcaggtgcctctccgcggagtctggacactgacccagggattgcaggcttccatccagcttaacgttattgtaccagggctgacagcctgctgggtgcaaagccctgttttggatacggaggagctggggaagctctgcagaaggtcgcaatagtgtggtgaccaagtggggcagagtaagattctcctggaggagcagtgcagaccctaagtgacagaagggtcaaccagggggacagtggggccagggtgacgaggaagggaatgcagacctcaaaggaggggccgtgggggcaaaggggagggttcttggatgtggaagggctttgaacaatgtttagatttggagatgagcccaaagtgccagggagaacagccaggtgaggtgggaggttggagagccaggtgaggtctctgtaagtcaggctggggttgaa

SEQ ID NO: 117494 - DNA, 546 bp, Homo sapiens
  Payload ID: 2943
  Gene Symbol: CHRNA2
  Gene Name: cholinergic receptor, nicotinic, alpha 2 (neuronal)
  ENST ID: ENST00000518712
  CDS Start-End: 304-546
acctgccactctatttctggggtgacttttgtcagctgcccagaatctccaagccaggctggttctctgcatcctttcaatgacctgttttcttctgtaaccacagacctcagtcctgatggtggcttagcaatgacagacacagtgctagggtctacggaacacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttca

SEQ ID NO: 117495 - DNA, 578 bp, Homo sapiens
  Payload ID: 2943
  Gene Symbol: CHRNA2
  Gene Name: cholinergic receptor, nicotinic, alpha 2 (neuronal)
  ENST ID: ENST00000520208
  CDS Start-End: 522-578
cacagtgggccaggattcgccatgcacaggaggagacaggagtactcatctgatactagagaaaaggaggcttcaccggaaaatcaaagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacagctgattgatgaactgcactgcattctgatggaagagtggagtcaaatctacacagtttgggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctc

SEQ ID NO: 117496 - DNA, 2030 bp, Homo sapiens
  Payload ID: 2944
  Gene Symbol: CHRNA3
  Gene Name: cholinergic receptor, nicotinic, alpha 3 (neuronal)
  Uniprot ID: P32297
  ENST ID: ENST00000348639
  CDS Start-End: 502-1971
gtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 117497 - DNA, 3202 bp, Homo sapiens
  Payload ID: 2944
  Gene Symbol: CHRNA3
  Gene Name: cholinergic receptor, nicotinic, alpha 3 (neuronal)
  Uniprot ID: P32297
  ENST ID: ENST00000326828
  CDS Start-End: 386-1903
ccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattataccatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactatggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgttcccttaggagcaaaattgcccctggttgagaaacattgctttagacaaattgttaagagtatcatgtactacacttctgaaacttaacgtgatcatcaccactgacagatgattcacagagactgtttgaatcttgtctcactagtttttcctgtgcaaaaataaaatggacagaattgcagccc

SEQ ID NO: 117498 - DNA, 1889 bp, Homo sapiens
  Payload ID: 2944
  Gene Symbol: CHRNA3
  Gene Name: cholinergic receptor, nicotinic, alpha 3 (neuronal)
  Uniprot ID: P32297
  ENST ID: ENST00000559658
  CDS Start-End: 70-1587
gaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagctggagtgcaatggcgtgatctcagctcaccgcaacctccgccacctgggttcaagcgattctcctgccgcagcctcccaggtagctgggattacaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 117499 - DNA, 535 bp, Homo sapiens
  Payload ID: 2944
  Gene Symbol: CHRNA3
  Gene Name: cholinergic receptor, nicotinic, alpha 3 (neuronal)
  ENST ID: ENST00000559080
  CDS Start-End: 483-535
gtttataatccttattttgactggtaaagacacaggttcagagaggttaagccacttgcctaagctcacacagcttacaagtgatttgtcaggatttgcaccagatctgtccaactccagagcccaggcttgcaaccactgtgcttctcactgaatgcgtgtggccaggtagaatcctgcccctcttgggcctcagtttcccattttgtaacccactgggttagactggcctgaaagtctagggttccacagaatccccccacaggtggaggggatgctgtagatgggtgatgtttctgctgggctgggtgggggaggttaagtaacgatttccccagggactgacagggctgcttcccacagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacct

SEQ ID NO: 117500 - DNA, 5577 bp, Homo sapiens
  Payload ID: 2945
  Gene Symbol: CHRNA4
  Gene Name: cholinergic receptor, nicotinic, alpha 4 (neuronal)
  Uniprot ID: P43681
  ENST ID: ENST00000370263
  CDS Start-End: 179-2062
agcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagcgctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatcacctgttagtggactttgcttgcagctgtcggtgattaggaatggaggtgccggtgtgtgcatggcactctatccgttatgcatgtttattttctgcatctgttaatgttttaacatctttcagacccaggactgctcctcctagggccagttagttcccgggggtggacagcttgcctagaacccaccttgccagggctgtgacccccgaccccctatcaaagtctcacactaagccaacgtttccccgccctgtgccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggccgcccggcttctgcaggcaatgtctgccaagccctggaatgtgctcccagtgtgtgcacagacttcaatgaataaaacgcaccgtcacca

SEQ ID NO: 117501 - DNA, 2052 bp, Homo sapiens
  Payload ID: 2945
  Gene Symbol: CHRNA4
  Gene Name: cholinergic receptor, nicotinic, alpha 4 (neuronal)
  ENST ID: ENST00000498043
  CDS Start-End: 1-413
ccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaactgcaggagagcccttttgggcaggagtgcttttcgccatcagaccccatcctggcctttctgggagaatagtgtggactgcagggtgccctggagagggtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctg

SEQ ID NO: 117502 - DNA, 5643 bp, Homo sapiens
  Payload ID: 2945
  Gene Symbol: CHRNA4
  Gene Name: cholinergic receptor, nicotinic, alpha 4 (neuronal)
  Uniprot ID: P43681
  ENST ID: ENST00000615287
  CDS Start-End: 545-2215
tcccagccggctgaggcgggcagggccgggcggggccgcgccacggagcccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaactgcaggagagcccttttgggcaggagtgcttttcgccatcagaccccatcctggcctttctgggagaatagtgtggactgcagggtgccctggagagggtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagcgctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatcacctgttagtggactttgcttgcagctgtcggtgattaggaatggaggtgccggtgtgtgcatggcactctatccgttatgcatgtttattttctgcatctgttaatgttttaacatctttcagacccaggactgctcctcctagggccagttagttcccgggggtggacagcttgcctagaacccaccttgccagggctgtgacccccgaccccctatcaaagtctcacactaagccaacgtttccccgccctgtgccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggccgc

SEQ ID NO: 117503 - DNA, 2192 bp, Homo sapiens
  Payload ID: 2945
  Gene Symbol: CHRNA4
  Gene Name: cholinergic receptor, nicotinic, alpha 4 (neuronal)
  ENST ID: ENST00000627000
  CDS Start-End: 140-475
ccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcagcctccccccgccccacctcatccaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctg

SEQ ID NO: 117504 - DNA, 3623 bp, Homo sapiens
  Payload ID: 2946
  Gene Symbol: CHRNA5
  Gene Name: cholinergic receptor, nicotinic, alpha 5 (neuronal)
  Uniprot ID: P30532
  ENST ID: ENST00000299565
  CDS Start-End: 201-1607
acatgcgtcccgagcccgccagaagctgctaggctgaggctgctgtcccggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatatgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaattgggaactcctttaaggcttactttattctttagatgcttaattattgtgttaactatttctgtagcttagcttccactgtaaagtcatacagtagacaactcctgtggacacgcagtagcatatccttaacattaatttcagtcctcttgtccacatttcccacaattaatagaaccatcttctatataaattgtggtagtatctctttatccttgatcttagaatagtcagtccactacaattacatgaaccccatttaaaaaacatatttagggccgggggcagtggctcacatctgtaatccaagcactttgggaggctgaggcaggtggatcaccagaggttaggagttcgagactagcctgaccaacatggtgaagccccgtctctactaagaatacaaaaaattagtcgggcatggtagcaggcgcctgtagtcccagctactcaagaggctgaggcaggagaatcgcttgaacctgggaggtggaggctgcagtgagccgagactgcgccattgcactccagcctggcaacaagagcaaaactctgtctcaaacatattttggtctaaatcattctgtgagaaaacaatcttctaatatgaaacacagtattctaatttggtatatgcacactgttatatacctgtaatatttcagttttctctccttcattctaacaattacaataatagaatcttagagttgcaagggcctttagatgtaatcaatcttagcctattactagtacagcgtaaatgatttagtacagtataatgtatcacagttaaaacagttaaattccatctctaaatgtcaccacttcaggtgtgaccaggtagcaaacactgacagaaaccctcgttcaatttagaactcttagctgttgagatcacaaacacctcatttatttataataagtaacctatctaagttcaagccaatgctctttggaaggcggaggagaccctatctaatttgcatttaatcgtaggcaggtgtttaatgccatttaatgagtgaaagcctggtgtgatgaatttagattgcctgccagctacctaccttagttcgtatacatccctgatccctcttatactaccattactgttacttatgatttttatatataaatttttatcgaca

SEQ ID NO: 117505 - DNA, 705 bp, Homo sapiens
  Payload ID: 2946
  Gene Symbol: CHRNA5
  Gene Name: cholinergic receptor, nicotinic, alpha 5 (neuronal)
  ENST ID: ENST00000394802
  CDS Start-End: 1-547
tcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagt

SEQ ID NO: 117506 - DNA, 755 bp, Homo sapiens
  Payload ID: 2946
  Gene Symbol: CHRNA5
  Gene Name: cholinergic receptor, nicotinic, alpha 5 (neuronal)
  ENST ID: ENST00000559576
  CDS Start-End: 1-170
tgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaa

SEQ ID NO: 117507 - DNA, 1051 bp, Homo sapiens
  Payload ID: 2946
  Gene Symbol: CHRNA5
  Gene Name: cholinergic receptor, nicotinic, alpha 5 (neuronal)
  ENST ID: ENST00000559554
  CDS Start-End: 150-632
cgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatt

SEQ ID NO: 117508 - DNA, 2400 bp, Homo sapiens
  Payload ID: 2947
  Gene Symbol: CHRNA6
  Gene Name: cholinergic receptor, nicotinic, alpha 6 (neuronal)
  Uniprot ID: Q15825
  ENST ID: ENST00000276410
  CDS Start-End: 357-1841
agaaagatctcagccactcacaggtgttcatcctcccggggtcctgtctgccccagcatttcttttctgcttttcttcccctttcttgcatgaagagacatctaggctgtcaggaaatgtgatgactcatctgacatcagatcgaatcttttttattcgcccttcatgtctgcctcagtctctgatcctggtaataaccgtgtgaagtcccggggatgttttgatttctgagaagacacacacggattgcagtgggcttctgatgatgtcaaggttggatgcatgtggctgactgatagctctttgttttccacaatcctttgcctaggaaaaaggaatccaagtgtgttttaaccatgctgaccagcaaggggcagggattccttcatgggggcttgtgtctctggctgtgtgtgttcacacctttctttaaaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtggatgaagtaaaccagatcatggaaaccaatttgtggctgcgtcacatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatcattggatcaaaagtggatatgaatgatttttgggaaaacagtgaatgggaaatcattgatgcctctggctacaaacatgacatcaaatacaactgttgtgaagagatatacacagatataacctattctttctacattagaagattgccgatgttttacacgattaatctgatcatcccttgtctctttatttcatttctaaccgtgttggtcttttaccttccttcggactgtggtgaaaaagtgacgctttgtatttcagtcctgctttctctgactgtgtttttgctggtcatcacagaaaccatcccatccacatctctggtggtcccactggtgggtgagtacctgctgttcaccatgatctttgtcacactgtccatcgtggtgactgtgtttgtgttgaacatacactaccgcaccccaaccacgcacacaatgcccaggtgggtgaagacagttttcctgaagctgctgccccaggtcctgctgatgaggtggcctctggacaagacaaggggcacaggctctgatgcagtgcccagaggccttgccaggaggcctgccaaaggcaagcttgcaagccatggggaacccagacatcttaaagaatgcttccattgtcacaaatcaaatgagcttgccacaagcaagagaagattaagtcatcagccattacagtgggtggtggaaaattcggagcactcgcctgaagttgaagatgtgattaacagtgttcagttcatagcagaaaacatgaagagccacaatgaaaccaaggaggtagaagatgactggaaatacgtggccatggtggtggacagagtatttctttgggtatttataattgtctgtgtatttggaactgcagggctatttctacagccactacttgggaacacaggaaaatcttaaaatgtattttcttttatgttcagaaatttacagacaccatatttgttctgcattccctgccacaaggaaaggaaagcaaaggcttcccacccaagtcccccatctgctaaaactgatggctacatggaaaaagaggactttcttgcacattaggaagcagaatatcctccagtgtagcacagggggagaagtgagaagtgttatgacattagtgccctgattgggcagcacccacggctacagtatcaggtcaggtttctcgtgtctgtgtgtttggcttctaaagacaagaatgacttacaatacagcctaattatgtaattaacatcaagccacactaaaaagttctgctgtacctccagtggatgctgtttctcagtattatgacatgtgacaggtgaactctgggaattggaccatgcaacatttgtgaactgtttgcaacactttgtgaactattgcatccttgatttcttgtgcatgtctctgtaatgtaactcaccctcctcagcattatttgatacactgattgttagttttaaaaaaaaaaaaaaaaaaa

SEQ ID NO: 117509 - DNA, 1872 bp, Homo sapiens
  Payload ID: 2947
  Gene Symbol: CHRNA6
  Gene Name: cholinergic receptor, nicotinic, alpha 6 (neuronal)
  Uniprot ID: Q15825
  ENST ID: ENST00000534622
  CDS Start-End: 181-1620
agtctctgatcctggtaataaccgtgtgaagtcccggggatgttttgatttctgagaagacacacacggattgcagtgggcttctgatgatgtcaaggttggatgcatgtggctgactgatagctctttgttttccacaatcctttgcctaggaaaaaggaatccaagtgtgttttaaccatgctgaccagcaaggggcagggattccttcatgggggcttgtgtctctggctgtgtgtgttcacacctttctttaaaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtgatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatcattggatcaaaagtggatatgaatgatttttgggaaaacagtgaatgggaaatcattgatgcctctggctacaaacatgacatcaaatacaactgttgtgaagagatatacacagatataacctattctttctacattagaagattgccgatgttttacacgattaatctgatcatcccttgtctctttatttcatttctaaccgtgttggtcttttaccttccttcggactgtggtgaaaaagtgacgctttgtatttcagtcctgctttctctgactgtgtttttgctggtcatcacagaaaccatcccatccacatctctggtggtcccactggtgggtgagtacctgctgttcaccatgatctttgtcacactgtccatcgtggtgactgtgtttgtgttgaacatacactaccgcaccccaaccacgcacacaatgcccaggtgggtgaagacagttttcctgaagctgctgccccaggtcctgctgatgaggtggcctctggacaagacaaggggcacaggctctgatgcagtgcccagaggccttgccaggaggcctgccaaaggcaagcttgcaagccatggggaacccagacatcttaaagaatgcttccattgtcacaaatcaaatgagcttgccacaagcaagagaagattaagtcatcagccattacagtgggtggtggaaaattcggagcactcgcctgaagttgaagatgtgattaacagtgttcagttcatagcagaaaacatgaagagccacaatgaaaccaaggaggtagaagatgactggaaatacgtggccatggtggtggacagagtatttctttgggtatttataattgtctgtgtatttggaactgcagggctatttctacagccactacttgggaacacaggaaaatcttaaaatgtattttcttttatgttcagaaatttacagacaccatatttgttctgcattccctgccacaaggaaaggaaagcaaaggcttcccacccaagtcccccatctgctaaaactgatggctacatggaaaaagaggactttcttgcacattaggaagcagaatatcctccagtgtagcacagggggagaagtgagaagtgttatgacattagtgccctgattgggcagcacccacggctacagtatcaggtc

SEQ ID NO: 117510 - DNA, 551 bp, Homo sapiens
  Payload ID: 2947
  Gene Symbol: CHRNA6
  Gene Name: cholinergic receptor, nicotinic, alpha 6 (neuronal)
  ENST ID: ENST00000533810
  CDS Start-End: 219-551
aagtacccagggacacaaacactgcggaaggccgcagggacctctgcctaggaaagccaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtggatgaagtaaaccagatcatggaaaccaatttgtggctgcgtcacatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatc

SEQ ID NO: 117511 - DNA, 5669 bp, Homo sapiens
  Payload ID: 2948
  Gene Symbol: CHRNA7
  Gene Name: cholinergic receptor, nicotinic, alpha 7 (neuronal)
  Uniprot ID: P36544
  ENST ID: ENST00000306901
  CDS Start-End: 98-1606
gagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccacaggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagccatctggctcactcatttctgggtaatgcacatgactttgtttgcactggaggaagatggaagcttgcgtgtgtgcggtgtgtgtgtgtgtgtaagtgtgaggtaccttgtgtgtgacaagagacctcacttacgagaaagttggtggatcaggacattccagcctcaggcggcttggagcaggatcattcctcagcaggcattccttccacatgctatggatgaaccatgcacaagattttcggtttttttttttttttctgttacagtgtctttagaaacaagtagaagtgttttgatatataaaaggaatgcttcatttcttatcattatcccaaaattgatccctcccacatttttgctttaaaaagaaacctttttggttttgtattttatacaggaacacaaaatgcaaacaagttgtgcatattttggactctcaaataacttctctgtcctttaataaagtaataataaggaatagatgtgcacatagttagaaaagtatgagtggttaaaaacaacagtctcccatactgcctgttttctctctcagaggggaccactaatgagcttctaagggcatttctagaaaggaagaaaagaagataagaggccaaagaaggagggacgggggttatggagagagaccttccctttccagcactaacgctctgtgaagggcgctgcaccttgcattcttcatgtggtgttttgtcttagaggtcgtcccataataacatataaagatctacctcattcctcctagtagctgcttagcattccattatctcagcggactatcatttatttgaatagccttttattggtgaacatatggatacttccagtttttatttttatatacaaatctataattggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgcattttcttctgaaactttatggttttattggtttaccttcacatcttcagactccctggaattcatttgttgcaggacatgagggaaaaatccatactttttcctcgaaatggtggtcagcagtatcaataaatatgtaataatgcatttctaaaatacagtcatagtgttttccccagttgttcaaaatgcagccttatttgtaaactaaatttctttaagtgtttggttctgtttctgttctatttatctctatgaatgcctttcatttctaaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcactaaggtgctttgaatttatagtttatttctagatgttttatcatttggctatcattttcaatagaatgatttattccactttattttctattttatcccattgtataagaaagtagttggtttttatgtatgaatgttataatcaaccacaaattgtgattcctacttgtttctaaggtatacttttgacttctcctttccaatgtgtctcttatttctttcttgtatctagttgatttgagatcagtgttgagtcacagtgattcaggtggcatgcttatcttgttcgtgacatcagtgggacgttttaatgtctcagcgtttaacttgtatgaagacatgtattttccttgccataataaaaaagtatctgtgtgttctcaaa

SEQ ID NO: 117512 - DNA, 1788 bp, Homo sapiens
  Payload ID: 2948
  Gene Symbol: CHRNA7
  Gene Name: cholinergic receptor, nicotinic, alpha 7 (neuronal)
  ENST ID: ENST00000437966
  CDS Start-End: 40-348
cgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaa

SEQ ID NO: 117513 - DNA, 2071 bp, Homo sapiens
  Payload ID: 2948
  Gene Symbol: CHRNA7
  Gene Name: cholinergic receptor, nicotinic, alpha 7 (neuronal)
  ENST ID: ENST00000455693
  CDS Start-End: 105-1613
ggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaagg

SEQ ID NO: 117514 - DNA, 2093 bp, Homo sapiens
  Payload ID: 2948
  Gene Symbol: CHRNA7
  Gene Name: cholinergic receptor, nicotinic, alpha 7 (neuronal)
  Uniprot ID: P36544
  ENST ID: ENST00000454250
  CDS Start-End: 108-1703
aaaggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacggtaaagccactgcctccccgccctccactcctccgtgggatcccgggcacatcccgggcgcctctgtgcgccccgcgcctgggccagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgta

SEQ ID NO: 117515 - DNA, 2276 bp, Homo sapiens
  Payload ID: 2949
  Gene Symbol: CHRNA9
  Gene Name: cholinergic receptor, nicotinic, alpha 9 (neuronal)
  Uniprot ID: Q9UGM1
  ENST ID: ENST00000310169
  CDS Start-End: 140-1579
atgcaatgcaagcctgagctctcccgccataaggctgcagcggtgtgggctccttgtgcccagatcctttgtattcatagggggaagtggaagaccacgctgcctgactgagactttattatagaggctcaggaaaaagatgaactggtcccattcctgcatctccttttgctggatctactttgctgcttccagactgagagctgcagagacggcagatggaaaatatgctcagaagttgtttaatgacctttttgaagattattctaatgctcttcgtccagtggaagatacagataaagtcctgaatgtgaccctgcagattacgctctctcagattaaggatatggatgaaagaaaccaaattctgactgcttatttgtggatccgccaaatctggcacgatgcctatctcacgtgggaccgagatcagtacgatggcctagactccatcaggatccccagtgacctcgtgtggaggccagacatcgtcttatataacaaggctgatgatgaatcttcagagcctgtgaacaccaatgtggtcctgcggtatgatgggctgatcacctgggatgcaccggccatcaccaaaagctcctgtgtggtggatgtcacctacttcccttttgacaaccagcagtgcaacctgacttttggttcctggacctacaatggcaatcaggtggacatattcaacgccttggacagcggagatctctctgacttcattgaagatgtggaatgggaggtccatggcatgcccgctgtgaagaatgtgatctcctatggctgctgctctgagccttacccggatgtcacattcaccctccttctgaagaggaggtcctcgttctatatcgtcaacctcctcatcccatgcgtcctcatatcttttctggctcctctgagtttttatctcccagcagcctccggagaaaaggtctccctgggagtgaccatcctgttggccatgactgtatttcagctaatggtggcagaaatcatgccggcctcagaaaatgtgcccctgataggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccaattccaaggggagtgaatggaagaaggtggcgaaagtcatagaccgattcttcatgtggatttttttcattatggtgtttgtgatgactattttgatcatagcaagagcggattagtcacagatattggctttgctatctgggtagaaattaatacaattccctgtgatctattccaatgttcttccaagatttttgttcatctataatttaggggttatgttgtctgtgctttttatttttagcttcaaatgaatgtcgaagctatctgctctgttaaattaagcagaagaaccaaaatttcaagggtaggaagatggaagaaatagggaaagagcccttttatagcccaccgtagtggtgggtgactggcctctagtttatataattatttacctctttggcagtacagataacaaaatacactttactggtaaaatttaaaacaaaaaaggcaaaacaaaacaaactcattttccccttagttcccattaaaatatgcatttgaaaaatgaaatagtcatatatatattagtgtgatttaagtctcaatggtaccttattcaggcatagtgcatttgaagtcatatctcaaatagtggaataaaaggttttgtcccatgtaaagaaagtctaagcatcagctgtttaatggggaaaagaactttcttcataatggtgatgtcgtatatgttggttatgttttatataaacccaaaagatgaagtcattcctgcatttaccctttgattaaaatatgatagatgaagctgttcctgcatttagtcttgtattaaaataaggtgattagcaa

SEQ ID NO: 117516 - DNA, 2557 bp, Homo sapiens
  Payload ID: 2950
  Gene Symbol: CHRNB1
  Gene Name: cholinergic receptor, nicotinic, beta 1 (muscle)
  Uniprot ID: P11230
  ENST ID: ENST00000306071
  CDS Start-End: 68-1573
gtcacttcccctgtgctggcggtcccagcggctctctgagcgaagtcactgagcgagccgccaggctatgaccccaggggctctgctgatgctgctgggggcgctgggggcgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggtggctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaagtgtcttgttcactgcagcatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctctaaaaaaataaaaatagaaataaagtagtgcttattgtttgcatgttgggtcttgtggtcgttttctttttacctttctgtaatttattatgttttgtaatgtgtactatctctgggattaaaaaaagttatttcta

SEQ ID NO: 117517 - DNA, 1623 bp, Homo sapiens
  Payload ID: 2950
  Gene Symbol: CHRNB1
  Gene Name: cholinergic receptor, nicotinic, beta 1 (muscle)
  Uniprot ID: P11230
  ENST ID: ENST00000536404
  CDS Start-End: 131-1420
cctgggacgagaccaggctgagatggaccagcctttggtgaagattggatcgaaatcagaccaatggacaagctctggccgtgggtggtggacgggcctggagtagaactggaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactct

SEQ ID NO: 117518 - DNA, 1837 bp, Homo sapiens
  Payload ID: 2950
  Gene Symbol: CHRNB1
  Gene Name: cholinergic receptor, nicotinic, beta 1 (muscle)
  ENST ID: ENST00000576360
  CDS Start-End: 103-1245
cagcctttggtgaagattggatcgaaatcagaccaatggacaagctctggccgtgggtggtggacgggcctggagtagaactggaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggtggctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatc

SEQ ID NO: 117519 - DNA, 947 bp, Homo sapiens
  Payload ID: 2950
  Gene Symbol: CHRNB1
  Gene Name: cholinergic receptor, nicotinic, beta 1 (muscle)
  ENST ID: ENST00000570557
  CDS Start-End: 1-947
ggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggcc

SEQ ID NO: 117520 - DNA, 539 bp, Homo sapiens
  Payload ID: 2950
  Gene Symbol: CHRNB1
  Gene Name: cholinergic receptor, nicotinic, beta 1 (muscle)
  ENST ID: ENST00000572857
  CDS Start-End: 65-539
acttcccctgtgctggcggtcccagcggctctctgagcgaagtcactgagcgagccgccaggctatgaccccaggggctctgctgatgctgctgggggcgctgggggcgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggctgttcttgaatgcgggggctcgagccatccaccagcctcggggggaacctccacaagtgctgagattacagccgagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgt

SEQ ID NO: 117521 - DNA, 1095 bp, Homo sapiens
  Payload ID: 2950
  Gene Symbol: CHRNB1
  Gene Name: cholinergic receptor, nicotinic, beta 1 (muscle)
  ENST ID: ENST00000575379
  CDS Start-End: 376-489
actttgaggggaggtgggaactaaaacagaggcggtggaagaagttgcacaaggctagagagatcactgctggagggaaaagcatgatgggctctcgggttttgagaactggcaagttgttggaggcagctggagcggggcctgggtcgccggcactggctgtctttgcgtttgggcgtggccagtcactcctcttccaggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggtggctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaa

SEQ ID NO: 117522 - DNA, 5867 bp, Homo sapiens
  Payload ID: 2951
  Gene Symbol: CHRNB2
  Gene Name: cholinergic receptor, nicotinic, beta 2 (neuronal)
  Uniprot ID: P17787
  ENST ID: ENST00000368476
  CDS Start-End: 265-1773
ctcctccccctcaccgtcccaattgtattccctggaagagcagccggaaaagcctccgcctgctcataccaggataggcaagaagctggtttctcctcgcagccggctccctgaggcccaggaaccaccgcggcggccggcaccacctggacccagctccaggcgggcgcggcttcagcaccacggacagcgccccacccgcggccctccccccggcggcgcgctccagccggtgtaggcgaggcagcgagctatgcccgcggcatggcccggcgctgcggccccgtggcgctgctccttggcttcggcctcctccggctgtgctcaggggtgtggggtacggatacagaggagcggctggtggagcatctcctggatccttcccgctacaacaagcttatccgcccagccaccaatggctctgagctggtgacagtacagcttatggtgtcactggcccagctcatcagtgtgcatgagcgggagcagatcatgaccaccaatgtctggctgacccaggagtgggaagattatcgcctcacctggaagcctgaagagtttgacaacatgaagaaagttcggctcccttccaaacacatctggctcccagatgtggtcctgtacaacaatgctgacggcatgtacgaggtgtccttctattccaatgccgtggtctcctatgatggcagcatcttctggctgccgcctgccatctacaagagcgcatgcaagattgaagtaaagcacttcccatttgaccagcagaactgcaccatgaagttccgttcgtggacctacgaccgcacagagatcgacttggtgctgaagagtgaggtggccagcctggacgacttcacacctagtggtgagtgggacatcgtggcgctgccgggccggcgcaacgagaaccccgacgactctacgtacgtggacatcacgtatgacttcatcattcgccgcaagccgctcttctacaccatcaacctcatcatcccctgtgtgctcatcacctcgctagccatccttgtcttctacctgccatccgactgtggcgagaagatgacgttgtgcatctcagtgctgctggcgctcacggtcttcctgctgctcatctccaagatcgtgcctcccacctccctcgacgtgccgctcgtcggcaagtacctcatgttcaccatggtgcttgtcaccttctccatcgtcaccagcgtgtgcgtgctcaacgtgcaccaccgctcgcccaccacgcacaccatggcgccctgggtgaaggtcgtcttcctggagaagctgcccgcgctgctcttcatgcagcagccacgccatcattgcgcccgtcagcgcctgcgcctgcggcgacgccagcgtgagcgcgagggcgctggagccctcttcttccgcgaagccccaggggccgactcctgcacgtgcttcgtcaaccgcgcgtcggtgcaggggttggccggggccttcggggctgagcctgcaccagtggcgggccccgggcgctcaggggagccgtgtggctgtggcctccgggaggcggtggacggcgtgcgcttcatcgcagaccacatgcggagcgaggacgatgaccagagcgtgagtgaggactggaagtacgtcgccatggtgatcgaccgcctcttcctctggatctttgtctttgtctgtgtctttggcaccatcggcatgttcctgcagcctctcttccagaactacaccaccaccaccttcctccactcagaccactcagcccccagctccaagtgaggcccttcctcatctccatgctctttcaccctgccaccctctgctgcacagtagtgttgggtggaggatggacgagtgagctaccaggaagaggggcgctgcccccacagatccatccttttgcttcatctggagtccctcctcccccacgcctccatccacacacagcagctccaacctggaggctggaccaactgctttgttttggctgctctccatctcttgtaccagcccaggcaatagtgttgaggaggggagcaaggctgctaagtggaagacagagatggcagagccatccaccctgaggagtgatgggcaaggggccaggaaggggacaggattgtctgctgcctccaagtcatgggagaagaggggtataggacaaggggtggaagggcaggagctcacaccgcaccgggctggcctgacacaatggtagctctgaagggaggggaagagagaggcctgggtgtgacctgacacctgccgctgcttgagtggacagcagctggactgggtgggccccacagtggtcagcgattcctgccaagtagggtttagccgggccccatggtcacagacccctgggggaggcttccagctcagtcccacagccccttgcttctaagggatccagagacctgctccagatcctctttccccactgaagaattctgcaccctctggacttccctcttcttccttcctttctcaggctcaaggtgtggggggcaaggctgagtattaggggagcttctgagttctgaatctttgggtgacctgcttggagtctcaggtccaaatacttgaaatctgtgagaagtccaagttcatgggcttttggaactggaagaactttgtacagccatggattccaacataagccatgttgcagatgaagaaactgacccacacggtgagacaagcacaggtgggtctgactcttcctccctgccctgagatccatctgtcgagtgccctgttttttccccactttgaactgactggttactctaaggaagtgaactgaggatgttagctttaagccaacccagcctctttgtccacagcagagctgaggtgaacagctggaaccctgctacatccgtgctgctccagtctgttctgctcatggctccatccttctggctgtcactcttcctcttccccttcccaaccaaacctgagcagctttgaagcagaacttgggaaggacagggctgctgctgccagcgacacctcagaaagcatagcctcggcttcctgccccatgtgtccctggaagctgtaccctgactctgcttccagaggccagcagatggtgggttacagacgggtcagcctgccaagtgcacctgagggacctgacctgacacaagccattttgtccctagagcccagctgggactcctgcttctctaggcagggcagagggaggagacacagcacaggcacagagcatgggacagggacccccgagtctggattcaagtcctggccctgctagtaactcatgtgagccagcttgagcaagtcccttcatcttgctagagctcagcttccttgcctataaaacgtaggtggcaatgccctcttcctgaggttgctgggaggataaggcagtgcttgtgaaaaagtctagcgctgtacctggcacagagtagatgcttcatgaatgttgagtctgacaggcaactggagctggtgagaatggggtcccctgactgtcatgccagcctccctcccaggcccactcttcccccctcttccctgaggaaaccaagtctcccttatcaggaagagctgggggagctgggaggaacattacaggaacaccagagggagtctagcgggtgggcaggcttctctctgcagccccctcagcagtttcattccattcctgggctgaacccttgccctggccctgcctcccttctgggtcagcacctcctgacacaggtgtgtgctcagggaccccaggctctagtcctgtactggctgtggaagcctatcactgggacaggaagccagtggctgcaggagacaggcctcagcgcatctcgtctgtcaggatgggctcacggacaccttttcttggtagcagggagtgtctctgcactatggaaactttccctcttctagagcggattgggagttgcctgtattatgcctgaaccctccttgaactcatggtcctggggaaggcgtcttggaaccagaaacagcaacaggaaaggagcctccctctgaagggtaggatgccggcctgaggccctccctcttggctctcccagggcctgggctaccccgaggccccagcagctgctgctgtggctgtacttgcttttaatatttcccatacatggctgttgtccaagttaagtcaccaaatggtgctagaggggatggcagagagcagcttgtccagctcctctccatgacccggttaacacacgagtaaacaggcctagagcttgtctgctgtttgacctcttttaagacccggctgtgctgcatctacaaaatgaagatgacagagctagccgaggtcttcagcaaggaagaaaggggtcagtgtatatgaaagggttacctgggcagtgtcattccctccatctctgtacgcagccctttgggaaccatcacaataaggaagaggtgagggcagaggtgaaggatccactgcccaggcaaggtgctaccatgtggtgggagagtgtgaaccctcaagtgcactgggaagctttggggaaccacagtctcttccacccttgggtcgtgtgtcgtcctcttctcttgatgtcagggaagcccctatgcctccttcccgtggtggggctatctctgcagagaatcgggtgcccagcttaatgctgggcaaggactggaggaagctccagatctggaggtggcagagatactggatggaaacctggagcaagggtttgggaggggaagtgaggaaacaggttgagactatctccatcagagatggcaaggccacaggtgatctgagaactatttttgtctgaaaagaaggcatgcacaggctctctgcttttgacaggtggcgttgcagtgggaggaaggcagcttcctggcggggagatagaaatactagaacagctggtaccaagttattgaaaatttaaaagcaaacaagacacagcagcccccaggtggtgtgttctactgaggaaggctacggcagaggaagggcaagaccgtttcccccaatggtcttgaaacggaagaggaaacagggagggctctttggatggtttggggacctggggctgtttgtatcccagtattagctcctgttactaagggtctgctctgcgccaggtcctcagcatgcgttgtctttattccgcgtgacaatcctatgggaaggggcctccacctacgtaacagaaatgcggctcagaaagaccaagtgacagctagtgagtagtgctgggcctgaaccccaaagtccacactcttgctatagccgctgaggcaggcagaagagctccttgggaggaaagtaaggggcattcaaagccttctctgaatcactccccaagccagagtagacctggttccagttgtcccccccttgtttccgggcagagtcaggcaggtgtcataccatccctccccgcccaaccagtgctggccagactcccattcaccgaccttgactagacagcgaacagccaccttttagtattcatcccaacaggtccaggcggtcagtgtgatagccacgcagttcctaagggactgtaggtctaggaatcattaggacactcactcagccaccctcgatgcccccatcttccccacactgcccttggcctccccgctctgcacgcctggagtatttgcactggtctagcctactccaggtcagactcattaggaactcaagattctcgtaaagaaagttgtttccaaagttgtcttgtcactctatttgggggttgggagagagcccgtgggggccagcgttggcgaatacaggaaaaagggagaatgctggagaaactggactcgtgagagcttaaagacatcacaagaatccaaagaaaaagtgagtggtgaca

SEQ ID NO: 117523 - DNA, 2294 bp, Homo sapiens
  Payload ID: 2952
  Gene Symbol: CHRNB3
  Gene Name: cholinergic receptor, nicotinic, beta 3 (neuronal)
  Uniprot ID: Q05901
  ENST ID: ENST00000289957
  CDS Start-End: 129-1505
tgttgctgtcctcttgggttccacttcggattttgaacccctgtattttcttttcaaaacccccttttccagtggaaatgctctgttgttaaaaaggaagaaactgtctttctgaaactgacatcacgatgctcccagattttatgctggttctcatcgtccttggcatcccttcctcagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggatgaaaagaatcagctgatgacaaccaatgtgtggctcaaacaggaatggacagaccacaagttacgctggaatcctgatgattatggtgggatccattccattaaagttccatcagaatctctgtggcttcctgacatagttctctttgaaaatgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtggttttgtctgagctgcaaactggggccgtgttatgcttgttagcaatgggccaggcaaatctcaacaagggtttggggattacactggcaggatagctggcactgcacacttaacaataacacagattccaagttgcctggcctaccgaagcaggtgttattcatggtttattcccagcatgataaggctttcagatggtgaaactggagcccactgtgagctgtgacttcctttaaggtcatgcataccaaaataactcacaatagaaacaaagccctttgctaccagaagtggattcattaatacccattatcttttcctagtaaactagtgtacagaa

SEQ ID NO: 117524 - DNA, 554 bp, Homo sapiens
  Payload ID: 2952
  Gene Symbol: CHRNB3
  Gene Name: cholinergic receptor, nicotinic, beta 3 (neuronal)
  ENST ID: ENST00000534391
  CDS Start-End: 527-554
acactcggcgagaggggttgagattgttttattccactccaggtgttgctgtcctcttgggttccacttcggattttgaacccctgtattttcttttcaaaacccccttttccagtggaaatgctctgttgttaaaaaggaagaaactgtctttctgaaactgacatcacgatgctcccagattttatgctggttctcatcgtccttggcatcccttcctcagacggaaagtgcaccttctgacagtggtaacacaggtggagatgtatgctgtgcgtgaaagagcagagctgcttgctgcccctggatcttggtgaggagcaggattcctgtaccttcacagggagcacagctgcccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggatgaaaagaatcagctgatgacaaccaatgtgtggctcaaacagg

SEQ ID NO: 117525 - DNA, 2623 bp, Homo sapiens
  Payload ID: 2953
  Gene Symbol: CHRNB4
  Gene Name: cholinergic receptor, nicotinic, beta 4 (neuronal)
  Uniprot ID: P30926
  ENST ID: ENST00000261751
  CDS Start-End: 113-1609
ccgccagcaaacctcgggggccaggaccggcgctcactcgaccgcgcggctcacgggtgccctgtgaccccacagcggagctcgcggcggctgccacccggccccgccggccatgaggcgcgcgccttccctggtccttttcttcctggtcgccctttgcgggcgcgggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaacgccgacgggacctatgaggtgtctgtctacaccaacttgatagtccggtccaacggcagcgtcctgtggctgccccctgccatctacaagagcgcctgcaagattgaggtgaagtactttcccttcgaccagcagaactgcaccctcaagttccgctcctggacctatgaccacacggagatagacatggtcctcatgacgcccacagccagcatggatgactttactcccagtggtgagtgggacatagtggccctcccagggagaaggacagtgaacccacaagaccccagctacgtggacgtgacttacgacttcatcatcaagcgcaagcctctgttctacaccatcaacctcatcatcccctgcgtgctcaccaccttgctggccatcctcgtcttctacctgccatccgactgcggcgagaagatgacactgtgcatctcagtgctgctggcactgacattcttcctgctgctcatctccaagatcgtgccacccacctccctcgatgtgcctctcatcggcaagtacctcatgttcaccatggtgctggtcaccttctccatcgtcaccagcgtctgtgtgctcaatgtgcaccaccgctcgcccagcacccacaccatggcaccctgggtcaagcgctgcttcctgcacaagctgcctaccttcctcttcatgaagcgccctggccccgacagcagcccggccagagccttcccgcccagcaagtcatgcgtgaccaagcccgaggccaccgccacctccaccagcccctccaacttctatgggaactccatgtactttgtgaaccccgcctctgcagcttccaagtctccagccggctctaccccggtggctatccccagggatttctggctgcggtcctctgggaggttccgacaggatgtgcaggaggcattagaaggtgtcagcttcatcgcccagcacatgaagaatgacgatgaagaccagagtgtcgttgaggactggaagtacgtggctatggtggtggaccggctgttcctgtgggtgttcatgtttgtgtgcgtcctgggcactgtggggctcttcctaccgcccctcttccagacccatgcagcttctgaggggccctacgctgcccagcgtgactgagggccccctgggttgtggggtgagaggatgtgagtggccgggtgggcactttgctgcttctttctgggttgtggctgatgaggccctaagtaaatatgtgagcattggccatcaaccccatcaaaccagccacagccgtggaacaggcaaggatgggggcctgggctgtcctctctgaatgccttggagggatcccaggaagccccagtaggagggagcttcagacagttcaattctggcctgtcttccttccctgcaccgggcaatggggataaagatgacttcgtagcagcacctactatgcttcaggcatggtgccggcctgcctctccatcaccatctctctccacttccccttgtccagttcctcacacacttctagattcttcccagctcagaggcttggcatttgccatatcatcatctttttttttttcttttaaacggagtcttgctatatcgcccaggctcaagtgattctcctgcctcaacctcccaagtagctgggattacagaaagccgccaccgtgcccagctaatttttgtatttttgttggccaggctgatttcgaactcctgacctcaaatgacccacctgcctcggcctcccaaagtgctaggattacaagtgtgagccactatgcctggccttccctatcttctacctgaaccttcttcctcttcccccagggcttcccaagctctttccacagccacatcagtcagggcatggctccaatccattctttgctccaatgtcacctcctctgagaggccttccctaaccacccaatcattctaaagcagcctccctacagtcacgttaccctgcctccttcctcgagcactcctgtgtacctgtcgctcttatctggtggcatgtatgtcatccacagctcacccactagagtgtgagctccatgagaacagggacctgctccttcacattcgtggtagtatccccagggcctaggacagagcttggcacacagtaggtgctcaataaatgtttgt

SEQ ID NO: 117526 - DNA, 1355 bp, Homo sapiens
  Payload ID: 2953
  Gene Symbol: CHRNB4
  Gene Name: cholinergic receptor, nicotinic, beta 4 (neuronal)
  Uniprot ID: P30926
  ENST ID: ENST00000412074
  CDS Start-End: 113-808
ccgccagcaaacctcgggggccaggaccggcgctcactcgaccgcgcggctcacgggtgccctgtgaccccacagcggagctcgcggcggctgccacccggccccgccggccatgaggcgcgcgccttccctggtccttttcttcctggtcgccctttgcgggcgcgggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaagtcgttgaggactggaagtacgtggctatggtggtggaccggctgttcctgtgggtgttcatgtttgtgtgcgtcctgggcactgtggggctcttcctaccgcccctcttccagacccatgcagcttctgaggggccctacgctgcccagcgtgactgagggccccctgggttgtggggtgagaggatgtgagtggccgggtgggcactttgctgcttctttctgggttgtggctgatgaggccctaagtaaatatgtgagcattggccatcaaccccatcaaaccagccacagccgtggaacaggcaaggatgggggcctgggctgtcctctctgaatgccttggagggatcccaggaagccccagtaggagggagcttcagacagttcaattctggcctgtcttccttccctgcaccgggcaatggggataaagatgacttcgtagcagcacctactatgcttcaggcatggtgccggcctgcctctccatcaccatctctctccacttccccttgtccagttcctcacacacttctagattcttcccagctcagaggcttggcatttgccatatcatcatctttttttttttcttttaaacggagtcttgctatatcgcccaggctcaagtgattctcctgcctcaacctcccaagtagctgggattacagaaagccgccaccgtgcccagctaatttttgtatttttgttggccaggctgatttcgaactcctgacctcaaatgacccacctgcctcggcctcccaaagtgctaggattacaagtgtgagccactatgcctggccttccctatcttctacctgaaccttcttcctcttcccccagggcttcccaagctctttccacagccacatcagtca

SEQ ID NO: 117527 - DNA, 2080 bp, Homo sapiens
  Payload ID: 2953
  Gene Symbol: CHRNB4
  Gene Name: cholinergic receptor, nicotinic, beta 4 (neuronal)
  ENST ID: ENST00000559849
  CDS Start-End: 872-1072
agacctgatgggaaagcagaggactgagccaaggcccaggtgatatagaaataaacaagaggctaggcgtggtggctcacacctgtaatcccagcacttgggaaggccaaggtgttgtgcagctggtggaggaggttgccatttacagtaaaggaaacattggctttttgacatcttatcttctacagcgtttgccaatgagtgctgcaggaattccctgtatatctgggtgctcccaacatccctgttgtgaaacgaaggagagttcatcataaaagtttttagcagcaaatttttttttttgctttgtgttactttattctacaagtgatttttatttacttacttgcacaaatttatggggcatgtgtgaaattttgttacgtgtatataatgcatagtgatcaagtcagtatttaggctgtccatctcatgagtgtagaacatttttgtttaaccctagtcaccctactatgctatcaatcattgaatttattccttttttttttttttttttgagacagagacttactctcttgcccaggctggagtgcagtggtgcagtctcagctcactgcaacctccacctcccgggttcaagcaattctcctgcctcagcctcccaagtagctgggactacagggtctcgctctgttgctcgagctggagtgtggtagcaccatcgtggctcactgcagccttgacctcccctggatcaagcgatcctcctacctcagcctcccaagtggctgggaccaatagatggaaagtcgtggagtcaccaggccggaagtgccgtggaggaaactcactccaatctgctgcatgaagagaggattctctgagactgagcaagctccagatttggcagatgggcggtagtttgctggccccagctccagatcatattgtattatggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgggttagaactccgtccctggaagaagctctgggggaacattcacaaggggagagtgcagggcgctgtgtccagccaggggaaagagaccaccaagggggctgaccctcctctggccagaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaagtgagtggcagggttggtggaggcctggtgacagccaggccagggcagcaggcccagccctaagagtcatccaggcctgagtccaaccctgagccccatctctgctttacccagccttccaggccatcaagctagaagagaaacagagcgccgacgggacctatgaggtgtctgtctacaccaacttgatagtccggtccaacggcagcgtcctgtggctgccccctgccatctacaagagcgcctgcaagattgaggtgaagtactttcccttcgaccagcagaactgcaccctcaagttccgctcctggacctatgaccacacggagatagacatggtcctcatgacgcccacagccagcatggatgactttactcccagtggtgagtgggacatagtggccctcccagggagaaggacagtgaacccacaagaccccagctacgtggacgtgacttacgacttcatcatcaagcgcaagcctctgttctacaccatcaacctcatcatcccctgcgtgctcaccaccttgctggccatcctcgtcttctacctgccatccgactgcggcgagaagatgacactgtgcatctcagtgctgctggcactgacattcttcctgctgctcatctccaagatcgtgccacccacctccctcgatgtgcctctcatcggcaagtacctcatgttcaccatggtgctggtcaccttctccatcgtcaccagcgtctgtgtgctca

SEQ ID NO: 117528 - DNA, 2112 bp, Homo sapiens
  Payload ID: 2954
  Gene Symbol: CHRND
  Gene Name: cholinergic receptor, nicotinic, delta (muscle)
  Uniprot ID: Q07001
  ENST ID: ENST00000258385
  CDS Start-End: 33-1586
gggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacc

SEQ ID NO: 117529 - DNA, 735 bp, Homo sapiens
  Payload ID: 2954
  Gene Symbol: CHRND
  Gene Name: cholinergic receptor, nicotinic, delta (muscle)
  ENST ID: ENST00000412233
  CDS Start-End: 29-544
agatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagca

SEQ ID NO: 117530 - DNA, 572 bp, Homo sapiens
  Payload ID: 2954
  Gene Symbol: CHRND
  Gene Name: cholinergic receptor, nicotinic, delta (muscle)
  ENST ID: ENST00000449596
  CDS Start-End: 57-572
attccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgcc

SEQ ID NO: 117531 - DNA, 3022 bp, Homo sapiens
  Payload ID: 2954
  Gene Symbol: CHRND
  Gene Name: cholinergic receptor, nicotinic, delta (muscle)
  ENST ID: ENST00000441621
  CDS Start-End: 224-931
tccgagctgcggggagtcccagcctgggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgacaa

SEQ ID NO: 117532 - DNA, 1580 bp, Homo sapiens
  Payload ID: 2954
  Gene Symbol: CHRND
  Gene Name: cholinergic receptor, nicotinic, delta (muscle)
  ENST ID: ENST00000446616
  CDS Start-End: 26-352
tgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatgcaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagg

SEQ ID NO: 117533 - DNA, 2918 bp, Homo sapiens
  Payload ID: 2954
  Gene Symbol: CHRND
  Gene Name: cholinergic receptor, nicotinic, delta (muscle)
  Uniprot ID: Q07001
  ENST ID: ENST00000543200
  CDS Start-End: 57-1565
attccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgac

SEQ ID NO: 117534 - DNA, 2455 bp, Homo sapiens
  Payload ID: 2955
  Gene Symbol: CHRNE
  Gene Name: cholinergic receptor, nicotinic, epsilon (muscle)
  Uniprot ID: Q04844
  ENST ID: ENST00000293780
  CDS Start-End: 12-1493
cacgcagcaggatggcaagggctccgcttggggtcctgctcctcttggggcttctcggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactgaatgaaaaagaggagactctcaccactagcgtctggattggaatcgattggcaggattaccgactcaactacagcaaggacgactttgggggtatagaaaccctgcgagtcccttcagaactcgtgtggctgccagagattgtgctggaaaacaatattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccgctctcagacgtacaatgccgaagaggtggagttcacttttgccgtagacaacgacggcaagaccatcaacaagatcgacatcgacacagaggcctatactgagaacggcgagtgggccatcgacttctgcccgggggtgatccgccgccaccacggtggcgccaccgacggcccaggggagactgacgtcatctactcgctcatcatccgccggaagccgctcttctacgtcattaacatcatcgtgccctgtgtgctcatctcgggcctggtgctgctcgcctacttcctgccggcgcaggccggcggccagaaatgcacggtctccatcaacgtcctgctcgcccagaccgtcttcttgttcctcattgcccagaaaatcccagagacttctctgagcgtgccgctcctgggcaggttccttattttcgtcatggtggtcgccacgctcattgtcatgaattgcgtcatcgtgctcaacgtgtcccagcggacgcccaccacccacgccatgtccccgcggctgcgccacgttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgtgtttgaggggcagaggcaccggcaggggacctggacggctgccttctgccagagcctgggcgccgccgcccccgaggtccgctgctgtgtggatgccgtgaacttcgtggccgagagcacgagagatcaggaggccaccggcgaggaagtgtccgactgggtgcgcatggggaatgcccttgacaacatctgcttctgggccgctctggtgctcttcagcgtgggctccagcctcatcttcctcggggcctacttcaaccgagtgcctgatctcccctacgcgccgtgtatccagccttagctcgcaccgacttcaatttcccacccatctccagtaggaaattgattttgaaaaagtaggctgccgccaccacggcattatgatcccttccccctgctgatcaatctgcagtttgtgaacttcacaagaatggtgtgtgcccgttccctggcgtgtgtaggcctggccgcagtccaggggtcagcaggaggaaagggttcacataggctctcaggtgccagtcttccagaaagcaaggactgcccttcattcagccttgctgacctcccagcctttctaaggctcagccccacgggactctggtggctgccagcttgtgagctatctatctatattcatttcatagccaaacaggagacccctttgcaggacttgcacacagggaggctgtagccaggaaaccctcttcttccctggtctggctctgctggagcgggtgggaaccaaacaccttcagtgctggtggccctcaggcccacaggtttaaggctgaggctgccctgacccttccacagtcatttcttctaggttttcttggcccagcactgcccatcccaccccatgaggctcactcattgcagatcccagcccaccctgcccctttcttccccaccctggaggctctctctgcctagtctacagtactgacagaaagcaaggacatgcggcctgcatggtgggagctggttgaattgtctttattaacaaacaggatatccaaggccactacattgaggaggggtggggggggagggagaagggttacttgctgctcacactatatacagatgcaagcaaggggcgtggagagtgagggctccctgctccctccctccaccggggaagggcatgggctagaagaggagaggggggtcgggaatggggggaatgttttggctggcggggtcccccctccattccctggagtttgggggaaggggaatcattaaagtgctttcaga

SEQ ID NO: 117535 - DNA, 1398 bp, Homo sapiens
  Payload ID: 2956
  Gene Symbol: CHRNG
  Gene Name: cholinergic receptor, nicotinic, gamma (muscle)
  Uniprot ID: P07510
  ENST ID: ENST00000389492
  CDS Start-End: 1-1398
atgcatgggggccaggggccgctgctcctcctgctgctgctggctgtctgcctgggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggatagagatgcagtggtgcgactatcgcctgcgctgggatccgcgagactacgaaggcctgtgggtgctgagggtgccgtccaccatggtgtggcggccggatatcgtgctggagaacaagtcccagacttacagcaccaatgagattgatctgcagctgagtcaggaagatggccagaccatcgagtggattttcattgaccctgaggccttcacagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaaggctgggggccagaagtgtaccgtcgccatcaacgtgctcctggcccagactgtcttcctcttccttgtggccaagaaggtgcctgaaacctcccaggcggtgccactcatcagcaagtacctgaccttcctcctggtggtgaccatcctcattgtcgtgaatgctgtggttgtgctcaatgtctccttgcggtctccacacacacactccatggcccgaggggtccgcaaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctagagaaaggcccggagttagggctgagccagttctgtggcagcctgaagcaggctgccccagccatccaggcctgtgtggaagcctgcaacctcattgcctgtgcccggcaccagcagagtcactttgacaatgggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactga

SEQ ID NO: 117536 - DNA, 2262 bp, Homo sapiens
  Payload ID: 2956
  Gene Symbol: CHRNG
  Gene Name: cholinergic receptor, nicotinic, gamma (muscle)
  Uniprot ID: P07510
  ENST ID: ENST00000389494
  CDS Start-End: 22-1575
actgcagagagctgaggcaccatgcatgggggccaggggccgctgctcctcctgctgctgctggctgtctgcctgggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggatagagatgcagtggtgcgactatcgcctgcgctgggatccgcgagactacgaaggcctgtgggtgctgagggtgccgtccaccatggtgtggcggccggatatcgtgctggagaacaacgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtcccagacttacagcaccaatgagattgatctgcagctgagtcaggaagatggccagaccatcgagtggattttcattgaccctgaggccttcacagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaaggctgggggccagaagtgtaccgtcgccatcaacgtgctcctggcccagactgtcttcctcttccttgtggccaagaaggtgcctgaaacctcccaggcggtgccactcatcagcaagtacctgaccttcctcctggtggtgaccatcctcattgtcgtgaatgctgtggttgtgctcaatgtctccttgcggtctccacacacacactccatggcccgaggggtccgcaaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctagagaaaggcccggagttagggctgagccagttctgtggcagcctgaagcaggctgccccagccatccaggcctgtgtggaagcctgcaacctcattgcctgtgcccggcaccagcagagtcactttgacaatgggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccctccactcagtgcactcccctcacttaggcaaagcattattcattcccatcagtctgaagcccgaaggactgttttgtataataccttcggacttgggactggctccccttttacaagttctccctgaaagagggcagtcacaagaggtgtgaagagtagcagccgatgctctctccaaagcagggcagcagcccataccagctggcatctcccccccgtgccttctgggtacaataagcacccaattctcaacagccccagtggcctttccattcatgtgcatttttctgccactgaccacaagacgatttcctgagttttgtaatcctcttttttttttttttttttttagtttttgatgtgttgttgttgttttgtttagttttgagatagagcctcactcttgtcatgcaagttggagtgga

SEQ ID NO: 117537 - DNA, 1739 bp, Homo sapiens
  Payload ID: 2957
  Gene Symbol: CHAD
  Gene Name: chondroadherin
  Uniprot ID: O15335
  ENST ID: ENST00000258969
  CDS Start-End: 94-1173
aaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtatt

SEQ ID NO: 117538 - DNA, 1789 bp, Homo sapiens
  Payload ID: 2957
  Gene Symbol: CHAD
  Gene Name: chondroadherin
  Uniprot ID: O15335
  ENST ID: ENST00000508540
  CDS Start-End: 154-1233
ggcctcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtatta

SEQ ID NO: 117539 - DNA, 594 bp, Homo sapiens
  Payload ID: 2957
  Gene Symbol: CHAD
  Gene Name: chondroadherin
  ENST ID: ENST00000506187
  CDS Start-End: 1-128
aggcctcccgcccagatgccacctgtgcctcacctgccaagttcaagggccagcacatccgtgacacggacgccttccgcagctgcaagttccccaccaagaggtccaagaaagctggccgccattaaacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtattata

SEQ ID NO: 117540 - DNA, 2533 bp, Homo sapiens
  Payload ID: 2958
  Gene Symbol: CHADL
  Gene Name: chondroadherin-like
  Uniprot ID: Q6NUI6
  ENST ID: ENST00000216241
  CDS Start-End: 54-2342
gacagcctgtccctgcgctgcgcctccaggctggaccagcagttccaggcggcatggaggggccccggagctccacccatgtccccttggtgctgccgcttcttgtacttctgctgctggccccggctaggcaggccgccgcccagcgctgcccacaggcctgcatctgtgacaactccaggcgacacgttgcctgccggtaccagaacctcactgaggtgccagacgccatccctgagctgacccagcggctggacctgcagggcaatttgctgaaggtgatccccgcagccgccttccagggcgtgcctcacctcacacacctggacctgcgccactgcgaggtggagctggtggccgagggcgccttccgtggcctgggccgcctgctcctgctcaacctggcctccaaccacctgcgtgagctgccccaggaggcgctggacgggctgggctcgttgcggcggctggagctggaggggaacgcactggaggagctgcggccggggacgttcggggcactgggtgcgctggccacgctaaacctggcccacaacgccctggtttacctgcccgccatggccttccaggggctactgcgcgtccgctggctgcggctgtcgcacaacgcgctcagcgtgctggcccccgaggccctggctggcctgcccgccctgagacggctcagcctacaccacaacgagctccaggctctgcccgggcctgtcttgtcccaggcccgcggcctggcccgtctggagctgggccacaacccgctcacctacgcgggcgaggaggacgggctggcgctgcccggcctgcgggagctgctgctggacggcggggccctgcaggccctgggtcccagggccttcgcacactgtccgcgcctgcacaccctcgacctccgcgggaaccagctagacaccctgcccccgctgcagggcccgggccagctgcgccggctgcggctgcaggggaatccgctgtggtgcggctgccaggcgcggcccctactcgagtggctggcgcgggcgcgcgtgcgctcggacggcgcgtgccaggggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggcctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccctgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtctcagccagctggagctcatcgacctcagcagcaatcccttccactgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaaccca

SEQ ID NO: 117541 - DNA, 2248 bp, Homo sapiens
  Payload ID: 2958
  Gene Symbol: CHADL
  Gene Name: chondroadherin-like
  ENST ID: ENST00000417999
  CDS Start-End: 1-2054
ggccccggagctccacccatgtccccttggtgctgccgcttcttgtacttctgctgctggccccggctaggcaggccgccgcccagcgctgcccacaggcctgcatctgtgacaactccaggcgacacgttgcctgccggtaccagaacctcactgaggtgccagacgccatccctgagctgacccagcggctggacctgcagggcaatttgctgaaggtgatccccgcagccgccttccagggcgtgcctcacctcacacacctggacctgcgccactgcgaggtggagctggtggccgagggcgccttccgtggcctgggccgcctgctcctgctcaacctggcctccaaccacctgcgtgagctgccccaggaggcgctggacgggctgggctcgttgcggcggctggagctggaggggaacgcactggaggagctgcggccggggacgttcggggcactgggtgcgctggccacgctaaacctggcccacaacgccctggtttacctgcccgccatggccttccaggggctactgcgcgtccgctggctgcggctgtcgcacaacgcgctcagcgtgctggcccccgaggccctggctggcctgcccgccctgagacggctcagcctacaccacaacgagctccaggctctgcccgggcctgtcttgtcccaggcccgcggcctggcccgtctggagctgggccacaacccgctcacctacgcgggcgaggaggacgggctggcgctgcccggcctgcgggagctgctgctggacggcggggccctgcaggccctgggtcccagggccttcgcacactgtccgcgcctgcacaccctcgacctccgcgggaaccagctagacaccctgcccccgctgcagggcccgggccagctgcgccggctgcggctgcaggggaatccgctgtggtgcggctgccaggcgcggcccctactcgagtggctggcgcgggcgcgcgtgcgctcggacggcgcgtgccaggggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggcctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccctgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaacccagca

SEQ ID NO: 117542 - DNA, 758 bp, Homo sapiens
  Payload ID: 2958
  Gene Symbol: CHADL
  Gene Name: chondroadherin-like
  ENST ID: ENST00000455425
  CDS Start-End: 1-758
agttccaggcggcatggaggggtgagtctttgggcccgatggtgcaaggggggattcagagcagctcagtggcctcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtctcagccagctggagctcatcgacctcagcagcaatcccttccactgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataaggttgg

SEQ ID NO: 117543 - DNA, 3013 bp, Homo sapiens
  Payload ID: 2959
  Gene Symbol: CHPF
  Gene Name: chondroitin polymerizing factor
  Uniprot ID: Q8IZ52
  ENST ID: ENST00000243776
  CDS Start-End: 250-2577
cggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggacttgtga

SEQ ID NO: 117544 - DNA, 1079 bp, Homo sapiens
  Payload ID: 2959
  Gene Symbol: CHPF
  Gene Name: chondroitin polymerizing factor
  ENST ID: ENST00000373891
  CDS Start-End: 36-932
gttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgaggtgggatgataagctatcccactgatacctccttgtcatgttcaaatccctctgagaggcaaagggatgttggagatacaggtctgcttttccatgccaattcggacatttattttctatctctgtgacccccagtaaattactaaatatcctggg

SEQ ID NO: 117545 - DNA, 2634 bp, Homo sapiens
  Payload ID: 2959
  Gene Symbol: CHPF
  Gene Name: chondroitin polymerizing factor
  Uniprot ID: Q8IZ52
  ENST ID: ENST00000535926
  CDS Start-End: 358-2199
aacttccgatggccctgccttcccgagagccgtggggccagtccgagactttctctgggccctatcccggcctgggctgaacttactggactgtgtcctaaaccggctcgacccgatggcgccccagagatcctactagctccctggctgggctgctggtgttagagaaatgacttatatatagggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggacttgtg

SEQ ID NO: 117546 - DNA, 3978 bp, Homo sapiens
  Payload ID: 2960
  Gene Symbol: CHPF2
  Gene Name: chondroitin polymerizing factor 2
  Uniprot ID: Q9P2E5
  ENST ID: ENST00000035307
  CDS Start-End: 1514-3832
aggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 117547 - DNA, 2709 bp, Homo sapiens
  Payload ID: 2960
  Gene Symbol: CHPF2
  Gene Name: chondroitin polymerizing factor 2
  ENST ID: ENST00000495645
  CDS Start-End: 277-2571
agctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgcc

SEQ ID NO: 117548 - DNA, 548 bp, Homo sapiens
  Payload ID: 2960
  Gene Symbol: CHPF2
  Gene Name: chondroitin polymerizing factor 2
  ENST ID: ENST00000482173
  CDS Start-End: 277-548
agctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcaga

SEQ ID NO: 117549 - DNA, 782 bp, Homo sapiens
  Payload ID: 2960
  Gene Symbol: CHPF2
  Gene Name: chondroitin polymerizing factor 2
  ENST ID: ENST00000465601
  CDS Start-End: 1-372
tgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccc

SEQ ID NO: 117550 - DNA, 3872 bp, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENST ID: ENST00000332246
  CDS Start-End: 655-2253
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 117551 - DNA, 3962 bp, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENST ID: ENST00000397998
  CDS Start-End: 458-1351
gggcttgttctgggatccgcagccttgctcaggctgtgcattggtgtggccccgaattgcacggagctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 117552 - DNA, 4232 bp, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENST ID: ENST00000454498
  CDS Start-End: 1015-2613
agatgcgctcggtcctcaccagcggcgttgtgcggcgaaccctgcggtgcttcgggaaggcggtcgttcctccctgctcccaccgttttccagcgtgtgcgctcttaccttctctggggaaaaaaggaaattttttattttttaacatttcatttcatgaaaccgttttttttaagtggtggcgctgaacacagtccttgcagaggggggcagcactttccctcctgaccccaacctggaaaccccagtgtgacttcagcgctgtcagagcattggaagcagagctgcgagttaggaagcggctcgctggcagctgggcacgtttctttcctgcgagatcggcttttttgatttgctctttttcacatgaaaatgttcagcttcatttttagacacctttagacatggttatcactgtttaaagccttgatttttttttaaacaaatagtttgcattttattcattgaaacagggagagaacaaataccatcctgctttttgggctgccttcctatttcaaggaaagacgccaaggtaattttgacccagaggagcaatgatgtagccacctcctaaccttcccttcttgaacccccagacataaagggagcagtaggcataaaatgtggggagctgaccatctgccggtccggtcctgaccttccactagtagtgagaccaatccagctcttgctgctgctgtggctttgtgaggaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 117553 - DNA, 554 bp, Homo sapiens
  Payload ID: 2961
  Gene Symbol: CSGALNACT1
  Gene Name: chondroitin sulfate N-acetylgalactosaminyltransferase 1
  ENST ID: ENST00000524213
  CDS Start-End: 512-554
aggctccgcggctgccggagcgggaggtggagccgagtccgcggcggccgcgcaggagggaaagttcagcgacggcggcagcggccggagccgggccgggcagctagcagggcgcttcggctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccggg

SEQ ID NO: 117554 - DNA, 792 bp, Homo sapiens
  Payload ID: 2961
  Gene Symbol: CSGALNACT1
  Gene Name: chondroitin sulfate N-acetylgalactosaminyltransferase 1
  ENST ID: ENST00000523262
  CDS Start-End: 481-792
ggcctcccagtggccgtcaggggtccctgcagacatcgcttacccacagtggtgcggtgtgagagttacaggggttcctgaccttcgctctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgct

SEQ ID NO: 117555 - DNA, 2352 bp, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENST ID: ENST00000519222
  CDS Start-End: 1160-2053
attctgcttttatctagttgacacatcggtttcctccattgatattcctaaaaggaagggacggctggggcccgttgtcactccctgcaaggcgcaatctccaggcaggggcagggcaggtctgggggcttcacgccccccagggagcgggtcacccggtgggactcgcgcccgccctctccttgggtgtcgtgttccctgggacgcgcccaccgttctccctggggagcgggaggctccaggcgcggctggggcgctgtgggcagatgcgctcggtcctcaccagcggcgttgtgcggcgaaccctgcggtgcttcgggaaggcggtcgttcctccctgctcccaccgttttccagcgtgtgcgctcttaccttctctggggaaaaaaggaaattttttattttttaacatttcatttcatgaaaccgttttttttaagtggtggcgctgaacacagtccttgcagaggggggcagcactttccctcctgaccccaacctggaaaccccagtgtgacttcagcgctgtcagagcattggaagcagagctgcgagttaggaagcggctcgctggcagctgggcacgtttctttcctgcgagatcggcttttttgatttgctctttttcacatgaaaatgttcagcttcatttttagacacctttagacatggttatcactgtttaaagccttgatttttttttaaacaaatagtttgcattttattcattgaaacagggagagaacaaataccatcctgctttttgggctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttggg

SEQ ID NO: 117556 - DNA, 646 bp, Homo sapiens
  Payload ID: 2961
  Gene Symbol: CSGALNACT1
  Gene Name: chondroitin sulfate N-acetylgalactosaminyltransferase 1
  ENST ID: ENST00000520003
  CDS Start-End: 486-646
agatgcgctcggtcctcaccagcggcgttgtgcggcgaaccctgcggtgcttcgggaaggcggtcgttcctccctgctcccaccgttttccagcctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaa

SEQ ID NO: 117557 - DNA, 766 bp, Homo sapiens
  Payload ID: 2961
  Gene Symbol: CSGALNACT1
  Gene Name: chondroitin sulfate N-acetylgalactosaminyltransferase 1
  ENST ID: ENST00000517494
  CDS Start-End: 477-766
gcctgcctgtgtgtgctggaggtggcggtggatcttttattacccaacactccacttgcctttttagcctttcctctccctcttctctcctggcctcccagtggccgtcaggggtccctgcagacatcgcttacccacagtggtgcggtgtgagagttacaggggttcctgaccttcgctgtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggca

SEQ ID NO: 117558 - DNA, 1990 bp, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENST ID: ENST00000522854
  CDS Start-End: 392-1990
ctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 117559 - DNA, 3730 bp, Homo sapiens
  Payload ID: 2962
  Gene Symbol: CSGALNACT2
  Gene Name: chondroitin sulfate N-acetylgalactosaminyltransferase 2
  Uniprot ID: Q8N6G5
  ENST ID: ENST00000374466
  CDS Start-End: 336-1964
cggcggcgggcccaaggcgtgaggcgccgcccgggtgtccccgcggcgcaggaggcggtggagcgcagagcgggcgagcgcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcagggatgtttgtattcatcaagacaagaagattcatctcacagtggtgtattttggtaaagaaggactgtctaaagtcaagtctatcctagaatctgtcaccagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaa

SEQ ID NO: 117560 - DNA, 8290 bp, Homo sapiens
  Payload ID: 2963
  Gene Symbol: CSPG4
  Gene Name: chondroitin sulfate proteoglycan 4
  Uniprot ID: Q6UVK1
  ENST ID: ENST00000308508
  CDS Start-End: 94-7062
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctaga

SEQ ID NO: 117561 - DNA, 4080 bp, Homo sapiens
  Payload ID: 2964
  Gene Symbol: CSPG5
  Gene Name: chondroitin sulfate proteoglycan 5 (neuroglycan C)
  Uniprot ID: O95196
  ENST ID: ENST00000264723
  CDS Start-End: 2100-3719
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 117562 - DNA, 4161 bp, Homo sapiens
  Payload ID: 2964
  Gene Symbol: CSPG5
  Gene Name: chondroitin sulfate proteoglycan 5 (neuroglycan C)
  Uniprot ID: O95196
  ENST ID: ENST00000383738
  CDS Start-End: 2100-3800
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgtaaggaaactttgcaacactccccgtacctcctccccccatgcccgtgccttggctcactatgataacgttatctgtcaggatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 117563 - DNA, 2089 bp, Homo sapiens
  Payload ID: 2964
  Gene Symbol: CSPG5
  Gene Name: chondroitin sulfate proteoglycan 5 (neuroglycan C)
  Uniprot ID: O95196
  ENST ID: ENST00000456150
  CDS Start-End: 523-1728
gtgtgatcctcgtcttgggggcagactccgggacggggcttagaggtaccgggtggctggggtcacactggggcggtggggtctgagggtggcgaggtctgggttgaccaggtctaggcgagcgggcctgaccggggcgggccggggctccagggctcctcagcgcgccgccctgacgtcccgccccttgccctcccgcccgcagcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 117564 - DNA, 2073 bp, Homo sapiens
  Payload ID: 2964
  Gene Symbol: CSPG5
  Gene Name: chondroitin sulfate proteoglycan 5 (neuroglycan C)
  ENST ID: ENST00000610462
  CDS Start-End: 177-1610
ggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaagatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaacttttt

SEQ ID NO: 117565 - DNA, 4550 bp, Homo sapiens
  Payload ID: 2965
  Gene Symbol: CHSY1
  Gene Name: chondroitin sulfate synthase 1
  Uniprot ID: Q86X52
  ENST ID: ENST00000254190
  CDS Start-End: 477-2885
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggagcctgcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgattca

SEQ ID NO: 117566 - DNA, 3850 bp, Homo sapiens
  Payload ID: 2966
  Gene Symbol: CHSY3
  Gene Name: chondroitin sulfate synthase 3
  Uniprot ID: Q70JA7
  ENST ID: ENST00000305031
  CDS Start-End: 359-3007
gggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtgctccagcggccgagggggagcccgaggaggaggacgggggcgcggctgggcagcggagagacggccggccggggagtagccacaacggcagcggggacgggggcgctgccgccccgagcgcccgaccccgggacttcctgtacgtgggggtgatgaccgcgcagaagtacctgggcagccgcgcgctggccgcgcagcggacctgggcgcgtttcatcccgggccgcgtggagttcttttccagccagcagccccccaacgccggccagcccccgccacccctgcctgtcatcgcgctaccgggtgtggacgactcctatcctccccagaaaaagtccttcatgatgatcaagtacatgcacgaccactacctggacaagtatgagtggttcatgcgcgccgacgacgatgtctacatcaaaggtgataaattagaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatgattacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactga

SEQ ID NO: 117567 - DNA, 2548 bp, Homo sapiens
  Payload ID: 2967
  Gene Symbol: CHODL
  Gene Name: chondrolectin
  Uniprot ID: Q9H9P2
  ENST ID: ENST00000299295
  CDS Start-End: 392-1213
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 117568 - DNA, 1974 bp, Homo sapiens
  Payload ID: 2967
  Gene Symbol: CHODL
  Gene Name: chondrolectin
  ENST ID: ENST00000338326
  CDS Start-End: 52-762
ttttcaggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctg

SEQ ID NO: 117569 - DNA, 2239 bp, Homo sapiens
  Payload ID: 2967
  Gene Symbol: CHODL
  Gene Name: chondrolectin
  Uniprot ID: Q9H9P2
  ENST ID: ENST00000400127
  CDS Start-End: 206-904
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 117570 - DNA, 2421 bp, Homo sapiens
  Payload ID: 2967
  Gene Symbol: CHODL
  Gene Name: chondrolectin
  Uniprot ID: Q9H9P2
  ENST ID: ENST00000400128
  CDS Start-End: 388-1086
ctgtggtgtttttcccccgctcctctggctgccttcctgatggatctctgtggtcccaggcaggaatggcctgcttggggacccagcgagctcccaaggcctttcctgctgcttcctctatccctgtgttttgcttggctctctaaattgactcagctccaggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 117571 - DNA, 2036 bp, Homo sapiens
  Payload ID: 2967
  Gene Symbol: CHODL
  Gene Name: chondrolectin
  ENST ID: ENST00000400131
  CDS Start-End: 106-816
gcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 117572 - DNA, 2136 bp, Homo sapiens
  Payload ID: 2967
  Gene Symbol: CHODL
  Gene Name: chondrolectin
  ENST ID: ENST00000400135
  CDS Start-End: 206-916
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 117573 - DNA, 1637 bp, Homo sapiens
  Payload ID: 2967
  Gene Symbol: CHODL
  Gene Name: chondrolectin
  Uniprot ID: Q9H9P2
  ENST ID: ENST00000543733
  CDS Start-End: 74-838
gcacactgcgttccaagttggggacttcccagaaaatgaagtcagctggagttgggccgaggtatacttggtaatgactgcaggttcggcacacagccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtc

SEQ ID NO: 117574 - DNA, 630 bp, Homo sapiens
  Payload ID: 2968
  Gene Symbol: CSAG1
  Gene Name: chondrosarcoma associated gene 1
  ENST ID: ENST00000361211
  CDS Start-End: 77-160
cttcctggatggggatccagatggaggtggagggttgatttgggaagcagagcacagcagcccaaatttgcttgtaatgtcggcgactacagtttctagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaatga

SEQ ID NO: 117575 - DNA, 875 bp, Homo sapiens
  Payload ID: 2968
  Gene Symbol: CSAG1
  Gene Name: chondrosarcoma associated gene 1
  ENST ID: ENST00000370287
  CDS Start-End: 329-565
acttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtagggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaatga

SEQ ID NO: 117576 - DNA, 1037 bp, Homo sapiens
  Payload ID: 2968
  Gene Symbol: CSAG1
  Gene Name: chondrosarcoma associated gene 1
  Uniprot ID: Q6PB30
  ENST ID: ENST00000370291
  CDS Start-End: 281-502
atggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggcgaggaaggggaaagcatcctctcatccctggcccagaagccctatcaaagtgaatggcccacccaagctctgactcctaccctgtcctcccctggcacaacccccaccccagcctgtaccatttctctatgaaacccctgttctcacccctcctccatcctcttccccaaaccagtgccctcctgtgatctccctgttggctttccaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaatga

SEQ ID NO: 117577 - DNA, 627 bp, Homo sapiens
  Payload ID: 2968
  Gene Symbol: CSAG1
  Gene Name: chondrosarcoma associated gene 1
  ENST ID: ENST00000452779
  CDS Start-End: 84-320
ctggattcttcctggatggggatccagatggaggtggagggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccagaagggaaaagggacccgtcaaggaagttccaggaacaaaaggctctccctaaaagaccaccgcttcaaaaaaacctgaggaatggagtgggccaacactatccagccactctgaccagccgaacgaggaactcaatcaaaatgcgccatagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatggaaataaaatgaacatgttgtaaaa

SEQ ID NO: 117578 - DNA, 3521 bp, Homo sapiens
  Payload ID: 2969
  Gene Symbol: CHRD
  Gene Name: chordin
  Uniprot ID: Q9H2X0
  ENST ID: ENST00000204604
  CDS Start-End: 247-3114
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 117579 - DNA, 3155 bp, Homo sapiens
  Payload ID: 2969
  Gene Symbol: CHRD
  Gene Name: chordin
  Uniprot ID: Q9H2X0
  ENST ID: ENST00000348986
  CDS Start-End: 1-2748
atgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 117580 - DNA, 1252 bp, Homo sapiens
  Payload ID: 2969
  Gene Symbol: CHRD
  Gene Name: chordin
  Uniprot ID: Q9H2X0
  ENST ID: ENST00000356534
  CDS Start-End: 247-507
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttcc

SEQ ID NO: 117581 - DNA, 3492 bp, Homo sapiens
  Payload ID: 2969
  Gene Symbol: CHRD
  Gene Name: chordin
  Uniprot ID: Q9H2X0
  ENST ID: ENST00000420973
  CDS Start-End: 247-1299
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 117582 - DNA, 3547 bp, Homo sapiens
  Payload ID: 2969
  Gene Symbol: CHRD
  Gene Name: chordin
  Uniprot ID: Q9H2X0
  ENST ID: ENST00000448472
  CDS Start-End: 247-531
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 117583 - DNA, 3384 bp, Homo sapiens
  Payload ID: 2969
  Gene Symbol: CHRD
  Gene Name: chordin
  ENST ID: ENST00000450923
  CDS Start-End: 113-2977
cccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggcccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 117584 - DNA, 1934 bp, Homo sapiens
  Payload ID: 2970
  Gene Symbol: CHRDL1
  Gene Name: chordin-like 1
  Uniprot ID: Q9BU40
  ENST ID: ENST00000372042
  CDS Start-End: 103-1479
cggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccat

SEQ ID NO: 117585 - DNA, 3860 bp, Homo sapiens
  Payload ID: 2970
  Gene Symbol: CHRDL1
  Gene Name: chordin-like 1
  Uniprot ID: Q9BU40
  ENST ID: ENST00000372045
  CDS Start-End: 133-1485
gacggagaaggccagtgcccaggttagtgagcagtgcccggcgcccgcttccctcacctccttttccagcctttgcacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 117586 - DNA, 2413 bp, Homo sapiens
  Payload ID: 2970
  Gene Symbol: CHRDL1
  Gene Name: chordin-like 1
  Uniprot ID: Q9BU40
  ENST ID: ENST00000394797
  CDS Start-End: 57-1427
gacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaata

SEQ ID NO: 117587 - DNA, 1658 bp, Homo sapiens
  Payload ID: 2970
  Gene Symbol: CHRDL1
  Gene Name: chordin-like 1
  Uniprot ID: Q9BU40
  ENST ID: ENST00000444321
  CDS Start-End: 111-1484
ccagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagccct

SEQ ID NO: 117588 - DNA, 1537 bp, Homo sapiens
  Payload ID: 2970
  Gene Symbol: CHRDL1
  Gene Name: chordin-like 1
  Uniprot ID: Q9BU40
  ENST ID: ENST00000482160
  CDS Start-End: 111-1247
ccagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaa

SEQ ID NO: 117589 - DNA, 1712 bp, Homo sapiens
  Payload ID: 2971
  Gene Symbol: CHRDL2
  Gene Name: chordin-like 2
  Uniprot ID: Q6WN34
  ENST ID: ENST00000263671
  CDS Start-End: 288-1643
ccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 117590 - DNA, 1665 bp, Homo sapiens
  Payload ID: 2971
  Gene Symbol: CHRDL2
  Gene Name: chordin-like 2
  ENST ID: ENST00000376324
  CDS Start-End: 450-878
ggacaaataaaaaggaaacaagcatgattgtgagggcagaggagcgtgggactgagtcaggagactggtgctgtcatcgctgcctggtgactgacttgctgtgtggccctcaggtgtaacttaccctctctgggcctcatttgtctaatcataataattaacgctgataccatgatataaatctgtacagcatttcactgcttgattccctaactgccctgtgagataagcgttaaggctcagagacagtggcatgcccagtgttgcacagtaagtgtgtggtaaagccgagattcaaactcagaccttctggccccttgcctaggagagcatgcccagttgtctagcagattctcttttgcctgagtggcccagatgacatctcttttagagctagaaagaaggagaaatgagacagggtctttgggctggagcctcctgggactaacatggcactggtcggtttgccaggcccagacatgttctgccttttccatgggaagagatactcccccggcgagagctggcacccctacttggagccacaaggcctgatgtactgcctgcgctgtacctgctcagagaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 117591 - DNA, 1867 bp, Homo sapiens
  Payload ID: 2971
  Gene Symbol: CHRDL2
  Gene Name: chordin-like 2
  Uniprot ID: Q6WN34
  ENST ID: ENST00000376332
  CDS Start-End: 498-1787
gccgccgcgccgccgccgctgctgggaccgccgccccgccgggccccaggcccccgcggcccgaccccgagcccaccgagcagggggcgccggccgcctctagcccgcgcgcccgcaacacccgctggtcccgcgcgcctcgcccggcgctgcgcgctcggcagacgccggtcctctccctgctttctcctcctctccctctcaccttccccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 117592 - DNA, 1219 bp, Homo sapiens
  Payload ID: 2971
  Gene Symbol: CHRDL2
  Gene Name: chordin-like 2
  ENST ID: ENST00000528789
  CDS Start-End: 295-1219
accttccccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaag

SEQ ID NO: 117593 - DNA, 1415 bp, Homo sapiens
  Payload ID: 2971
  Gene Symbol: CHRDL2
  Gene Name: chordin-like 2
  Uniprot ID: Q6WN34
  ENST ID: ENST00000534276
  CDS Start-End: 450-878
ggacaaataaaaaggaaacaagcatgattgtgagggcagaggagcgtgggactgagtcaggagactggtgctgtcatcgctgcctggtgactgacttgctgtgtggccctcaggtgtaacttaccctctctgggcctcatttgtctaatcataataattaacgctgataccatgatataaatctgtacagcatttcactgcttgattccctaactgccctgtgagataagcgttaaggctcagagacagtggcatgcccagtgttgcacagtaagtgtgtggtaaagccgagattcaaactcagaccttctggccccttgcctaggagagcatgcccagttgtctagcagattctcttttgcctgagtggcccagatgacatctcttttagagctagaaagaaggagaaatgagacagggtctttgggctggagcctcctgggactaacatggcactggtcggtttgccaggcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacaatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaag

SEQ ID NO: 117594 - DNA, 344 bp, Homo sapiens
  Payload ID: 2971
  Gene Symbol: CHRDL2
  Gene Name: chordin-like 2
  ENST ID: ENST00000529912
  CDS Start-End: 1-275
caggtgacaggagcaggatcagcaaagagaacagacagaagaaaacaggcttcactgtggaggcgacaggacgtcagggaaggggaatgacagggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 117595 - DNA, 669 bp, Homo sapiens
  Payload ID: 2971
  Gene Symbol: CHRDL2
  Gene Name: chordin-like 2
  ENST ID: ENST00000525413
  CDS Start-End: 1-533
gttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 117596 - DNA, 1321 bp, Homo sapiens
  Payload ID: 2971
  Gene Symbol: CHRDL2
  Gene Name: chordin-like 2
  Uniprot ID: Q6WN34
  ENST ID: ENST00000528471
  CDS Start-End: 450-731
ggacaaataaaaaggaaacaagcatgattgtgagggcagaggagcgtgggactgagtcaggagactggtgctgtcatcgctgcctggtgactgacttgctgtgtggccctcaggtgtaacttaccctctctgggcctcatttgtctaatcataataattaacgctgataccatgatataaatctgtacagcatttcactgcttgattccctaactgccctgtgagataagcgttaaggctcagagacagtggcatgcccagtgttgcacagtaagtgtgtggtaaagccgagattcaaactcagaccttctggccccttgcctaggagagcatgcccagttgtctagcagattctcttttgcctgagtggcccagatgacatctcttttagagctagaaagaaggagaaatgagacagggtctttgggctggagcctcctgggactaacatggcactggtcggtttgccaggcccagacatgttctgccttttccatgggaagagatactcccccggcgagagctggcacccctacttggagccacaaggcctgatgtactgcctgcgctgtacctgctcagagaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacaatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaag

SEQ ID NO: 117597 - DNA, 1691 bp, Homo sapiens
  Payload ID: 2971
  Gene Symbol: CHRDL2
  Gene Name: chordin-like 2
  ENST ID: ENST00000622063
  CDS Start-End: 846-1691
gccgccgcgccgccgccgctgctgggaccgccgccccgccgggccccaggcccccgcggcccgaccccgagcccaccgagcagggggcgccggccgcctctagcccgcgcgcccgcaacacccgctggtcccgcgcgcctcgcccggcgctgcgcgctcggcagacgccggtcctctccctgctttctcctcctctccctctcaccttccccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagctggctccagctggggcctgctatgctcagtcagtgactttcatccttcctgccatttgcagagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagacgtcttcctagcccagaccctggagctgaaggtcacggccagtccagacaaagtgaccaagacataa

SEQ ID NO: 117598 - DNA, 877 bp, Homo sapiens
  Payload ID: 2972
  Gene Symbol: CGB
  Gene Name: chorionic gonadotropin, beta polypeptide
  Uniprot ID: P01233
  ENST ID: ENST00000357383
  CDS Start-End: 363-860
agcacctttctcgggtcacggcctcctcctggctcccaggaccccaccataggcagaggcaggccttcctacaccctactccctgtgcctccagcctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaggggttagtgtcgagctcaccccagcatcctatcacctcctggtggccttgccgcccccacaaccccgaggtataaagccaggtacacgaggcaggggacgcaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagcccatcccgactcccggggccctcggacaccccgatcctcccacaataaaggcttctcaatccgca

SEQ ID NO: 117599 - DNA, 573 bp, Homo sapiens
  Payload ID: 2973
  Gene Symbol: CGB1
  Gene Name: chorionic gonadotropin, beta polypeptide 1
  Uniprot ID: A6NKQ9
  ENST ID: ENST00000301407
  CDS Start-End: 106-573
gtccaacacccctcactccctgtctcactcccccacggagactcaatttactttccatgtccacattcccagtgcttgcggaagatatcccgctaagagagagacatgtcaaagaggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgtctcccggggccctag

SEQ ID NO: 117600 - DNA, 786 bp, Homo sapiens
  Payload ID: 2973
  Gene Symbol: CGB1
  Gene Name: chorionic gonadotropin, beta polypeptide 1
  ENST ID: ENST00000601167
  CDS Start-End: 398-786
ctggagggaggaaggggaactgcatctgagagagagcagccaattgggtccgctgactctggccaggttcccgtgccgcgtccaacacccctcactccctgtctcactcccccacggagactcaatttactttccatgtccacattcccagtgcttgcggaagatatcccgctaagagagagacatgtcaaaggtagggtagatccacatttccgggcaccaaagatggagatgttccaggaaagactgcagggcccctgggcaccttccacctccttccaggccatcactggcatgagaaggggcagacccgtgtgagctgtggaaggaggcctctttctggaggagcgtgacccccagtaagcttcagaggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccc

SEQ ID NO: 117601 - DNA, 627 bp, Homo sapiens
  Payload ID: 2974
  Gene Symbol: CGB2
  Gene Name: chorionic gonadotropin, beta polypeptide 2
  ENST ID: ENST00000359342
  CDS Start-End: 119-610
gttcccgtgccgcgtccaacacccctcactccctgtctcactcccccacggagactcaatttactttccatgtccacatccccagtgcttgcggaagatatcccgctaagagagagacatgtcaaaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagcccatcccgactcccggggccctcagacaccccgatcctcccacaataaaggcttctcaatccgca

SEQ ID NO: 117602 - DNA, 775 bp, Homo sapiens
  Payload ID: 2974
  Gene Symbol: CGB2
  Gene Name: chorionic gonadotropin, beta polypeptide 2
  ENST ID: ENST00000474913
  CDS Start-End: 387-775
ctggagggaggaaggggaactgtatctgagagagagcagccaattgggtccgctgactccggccgggttcccgtgccgcgtccaacacccctcactccctgtctcactcccccacggagactcaatttactttccatgtccacatccccagtgcttgcggaagatatcccgctaagagagagacatgtcaaaggtagggtagatcgacatttccaggcaccaaagatggagatgttccaggaaagactgcagggcccctgggcaccttccacctgcttccaggccatcactggcatgagaaggggcagaccagtgtgagctgtggaaggaggcctctttctggaggagcgtgacccccagggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccc

SEQ ID NO: 117603 - DNA, 841 bp, Homo sapiens
  Payload ID: 2975
  Gene Symbol: CGB5
  Gene Name: chorionic gonadotropin, beta polypeptide 5
  Uniprot ID: P01233
  ENST ID: ENST00000301408
  CDS Start-End: 327-824
caggaccccaccataggcagaggcaggccttcctacaccctactccctgtgcctccaggctcgactagtccctagcactcgacgactgagtctctgagatcacttcaccgtggtctccgcctcacccttggcgctggaccagtgagaggagagggctggggcgctccgctgagccactcctgcgcccccctggccttgtctacctcttgccccccgaagggttagtgtcgagctcaccccagcatcctacaacctcctggtggccttgccgcccccacaaccccgaggtataaagccaggtacacgaggcaggggacgcaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgca

SEQ ID NO: 117604 - DNA, 918 bp, Homo sapiens
  Payload ID: 2976
  Gene Symbol: CGB7
  Gene Name: chorionic gonadotropin, beta polypeptide 7
  Uniprot ID: P01233
  ENST ID: ENST00000377280
  CDS Start-End: 405-902
tgcaggaatggctcaagtagaggagggttgaggcttcagtccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgc

SEQ ID NO: 117605 - DNA, 1949 bp, Homo sapiens
  Payload ID: 2976
  Gene Symbol: CGB7
  Gene Name: chorionic gonadotropin, beta polypeptide 7
  Uniprot ID: P01233
  ENST ID: ENST00000596965
  CDS Start-End: 1436-1933
gcatccacgccaggccagaaggaccaggggctggaaactcgccttcagggctcctaagctgctgcggagctagacggcgggctgtgggctctaatcgcctgcacgaagaaccccgcgctgtctggcccacccttcacagtatccgaccggggcgtcctgaaccgccgccagctctatctgaccacctcggcgcgggactttcggttctatcccaagacggagccgtccggatacccccgcaaggactacctgacctactggagcttagaagagacgccccaactctggagtcacgacccgcagcggcagccctgtctctgctcttccaggccgcctcgagcgccgcacggcgggccatgtctccggctcaggaaacctacagctcctcgccgcacccgctccgccggctcgaccgcttccgcccgctggaggcgacttggggtggcccccactggaagcccctgccgggcatacacagcgtcccgaaagcctacagcaccgagaactcccgctcaggccgctgtaagccggggctagtgggagcctgccgggccagccccaccccagacacgccccctggcgtgggggcggagcagagctctgggcagccgctcactacgcggtgtcggacctaggtgggctcgcactcattaagtctatccgcagtgtggggacaggactagcccagacacgcccactcagctgcggctggatcgcggggaagggactaagtccagacaatgtcctccgaggctgcggccccgcgggcaggacacacctcctgcgggcctattcaataatcagttaaatcacctgaagcacacgcatttccggggaccgctccgggcatcctggcttgagggtagggtgggcggaggttcctaagggagaggtggggctcgggctgaatccctcgttggggggcatctgggtcaagtggcttccctggcagcacagtcacggggagaccctctctcactgggcagaagctaagtccgaagccgcgcccctcctgttaggttggactgtggtgcaggaatggctcaagtagaggagggttgaggcttcagtccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgc

SEQ ID NO: 117606 - DNA, 3386 bp, Homo sapiens
  Payload ID: 2976
  Gene Symbol: CGB7
  Gene Name: chorionic gonadotropin, beta polypeptide 7
  Uniprot ID: P01233
  ENST ID: ENST00000597853
  CDS Start-End: 2873-3370
ctttcattggctggattggggtgggcgggttctgtcacctggggcaacagcaacaaaccagctcctgcttggctacagggagggggtggaaccatggccagtggcaccctggctgtgcgctgtggccccccgtggtctttcatctctgcaaccgagatgcctgaatcctggcccaactggcatctcaccagcagctacgttacccatggcattatcccacccgtacccttccccccgcccacggtgcaggtgggcagaccctaggctgaagccctgcggggcctggggacccagaaagatgggggctgagaaaaggggattgggagcttggactcctctctgaaggaggagggtcctggagtcctgggtctgagagaggaggcgccagggaatttggatgccagggactgcagaggaaagggctgggggccgactggaagaggtcagagtttggggtggggggtgatagggactcctgagtctttctagctgatgtgcggcgccttctctccagtccacggtcgcggaccctctacctccgactgcaaagcaggattctcgcatctgggctttcgacgaggtcctcagcagatgggagacaacctctggctcggcctacgtgcccaagacccatggcgggccctgcgcccagcccagagccccagagcctgcagaccccacgcggactgtggggatcaaggattcaggagaaaagctcagacaccgcagctgaaccctcctactgaccacaaagtaccagagcagcgagacgagggcgcagtacacttgctctcccggcccggacgcgcgcgcccccaaatacgtcgggccccagcccctcacaactctcggaccaccaccgcggggggccttcccaggtgtctgggtggaagccggcgctggcgagaccagcggagctccgggagcctggggcggggccagaaggaaatcacagctttggggcgtggctaaaggatctggggcgggatcgggaggttagaggagcgggaggaagggctgggcatccacgccaggccagaaggaccaggggctggaaactcgccttcagggctcctaagctgctgcggagctagacggcgggctgtgggtggggaggagactagaatattctgagacgtggtagggtgggagttaggagaggtaacctggagttgttgcccaagatgcagctcagctccagtggccacaccaagaaggcttgagaccgggggcagaaccagggggattttgtggtggctgggggcctgcatttgagttccttgaccagcaggagggcttggatttagggaggtgaggctgggaagggttcgggtatgagaaaggaagctgaagttccctggcgtgggtggcaggaagggctctgaccctggggcggggtgtgagggccgtggccgtcatggctgtcgaggccgaaggagagggattctgaactcgggacccaggacttgggatggggtatgaaatctatgtcttgggtatgcctcctcccccaatcttgctcaggctctaatcgcctgcacgaagaaccccgcgctgtctggcccacccttcacagtatccgaccggggcgtcctgaaccgccgccagctctatctgaccacctcggcgcgggactttcggttctatcccaagacggagccgtccggatacccccgcaaggactacctgacctactggagcttagaagagacgccccaactctggagtcacgacccgcagcggcagccctgtctctgctcttccaggccgcctcgagcgccgcacggcgggccatgtctccggctcaggaaacctacagctcctcgccgcacccgctccgccggctcgaccgcttccgcccgctggaggcgacttggggtggcccccactggaagcccctgccgggcatacacagcgtcccgaaagcctacagcaccgagaactcccgctcaggccgctgtaagccggggctagtgggagcctgccgggccagccccaccccagacacgccccctggcgtgggggcggagcagagctctgggcagccgctcactacgcggtgtcggacctaggtgggctcgcactcattaagtctatccgcagtgtggggacaggactagcccagacacgcccactcagctgcggctggatcgcggggaagggactaagtccagacaatgtcctccgaggctgcggccccgcgggcaggacacacctcctgcgggcctattcaataatcagttaaatcacctgaagcacacgcatttccggggaccgctccgggcatcctggcttgagggtagggtgggcggaggttcctaagggagaggtggggctcgggctgaatccctcgttggggggcatctgggtcaagtggcttccctggcagcacagtcacggggagaccctctctcactgggcagaagctaagtccgaagccgcgcccctcctgttaggttggactgtggtgcaggaatggctcaagtagaggagggttgaggcttcagtccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgc

SEQ ID NO: 117607 - DNA, 882 bp, Homo sapiens
  Payload ID: 2977
  Gene Symbol: CGB8
  Gene Name: chorionic gonadotropin, beta polypeptide 8
  Uniprot ID: P01233
  ENST ID: ENST00000448456
  CDS Start-End: 368-865
agtccagcacctttctcgggtcacggcctcctcctggctcccaggaccccaccataggcagaggcaggccttcctacaccctactccctgtgcctccaggctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaagggttagtgtcgagctcactccagcatcctacaacctcctggtggccttgccgcccccacaaccccgaggtttaaagccaggtacacgaggcaggggacacaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgca

SEQ ID NO: 117608 - DNA, 900 bp, Homo sapiens
  Payload ID: 2978
  Gene Symbol: CSH1
  Gene Name: chorionic somatomammotropin hormone 1 (placental lactogen)
  Uniprot ID: P0DML2
  ENST ID: ENST00000316193
  CDS Start-End: 143-796
atgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatca

SEQ ID NO: 117609 - DNA, 1073 bp, Homo sapiens
  Payload ID: 2978
  Gene Symbol: CSH1
  Gene Name: chorionic somatomammotropin hormone 1 (placental lactogen)
  ENST ID: ENST00000329882
  CDS Start-End: 72-842
accggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaa

SEQ ID NO: 117610 - DNA, 632 bp, Homo sapiens
  Payload ID: 2978
  Gene Symbol: CSH1
  Gene Name: chorionic somatomammotropin hormone 1 (placental lactogen)
  ENST ID: ENST00000453363
  CDS Start-End: 151-519
atgcataaatgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcatctg

SEQ ID NO: 117611 - DNA, 580 bp, Homo sapiens
  Payload ID: 2978
  Gene Symbol: CSH1
  Gene Name: chorionic somatomammotropin hormone 1 (placental lactogen)
  ENST ID: ENST00000610991
  CDS Start-End: 166-552
atcccaaggcccaactccccgaaccactcagggtcctgtggacagctcacctagtggcaatggctccaggaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctc

SEQ ID NO: 117612 - DNA, 598 bp, Homo sapiens
  Payload ID: 2979
  Gene Symbol: CSH2
  Gene Name: chorionic somatomammotropin hormone 2
  Uniprot ID: P0DML3
  ENST ID: ENST00000345366
  CDS Start-End: 116-484
cagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 117613 - DNA, 1173 bp, Homo sapiens
  Payload ID: 2979
  Gene Symbol: CSH2
  Gene Name: chorionic somatomammotropin hormone 2
  Uniprot ID: P0DML3
  ENST ID: ENST00000336844
  CDS Start-End: 153-656
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcgccaatcctggaaccccactggcttagagggctgggggagagaaacactgctgccctctttgtagcagtcaggcgctgacccaagagaactcaccttattcttcatttcgcctggtgaatcctccaggcccttctctacaccctgaaggggagggaggaaaatggatgaatgagagagggagggaacagtgcccaagcgcttggcctctccttctcttccttcactttgcagaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 117614 - DNA, 920 bp, Homo sapiens
  Payload ID: 2979
  Gene Symbol: CSH2
  Gene Name: chorionic somatomammotropin hormone 2
  Uniprot ID: P0DML3
  ENST ID: ENST00000392886
  CDS Start-End: 153-806
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 117615 - DNA, 749 bp, Homo sapiens
  Payload ID: 2979
  Gene Symbol: CSH2
  Gene Name: chorionic somatomammotropin hormone 2
  ENST ID: ENST00000560142
  CDS Start-End: 153-635
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctgactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 117616 - DNA, 666 bp, Homo sapiens
  Payload ID: 2979
  Gene Symbol: CSH2
  Gene Name: chorionic somatomammotropin hormone 2
  ENST ID: ENST00000613718
  CDS Start-End: 169-555
aggatcccaaggcccaactccccgaaccactcagggtcctgtggacagctcacctagcggcaatggctgcaggaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatt

SEQ ID NO: 117617 - DNA, 842 bp, Homo sapiens
  Payload ID: 2979
  Gene Symbol: CSH2
  Gene Name: chorionic somatomammotropin hormone 2
  ENST ID: ENST00000620751
  CDS Start-End: 63-731
aggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgtaagttcttggggaatggaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatt

SEQ ID NO: 117618 - DNA, 739 bp, Homo sapiens
  Payload ID: 2980
  Gene Symbol: CSHL1
  Gene Name: chorionic somatomammotropin hormone-like 1
  ENST ID: ENST00000259003
  CDS Start-End: 146-628
ataaatgtgcacagaaacaggtgggggcaacagcgagagagaaggggccagggtataaaaagggcccacaagagaccagctccagcatcccaaggcccgactccccgcaccactcagggtcctgtggacagctcacctagcggcaatggctgcaggctcccggacgtccctgctcctggcttttgccctgctctgcctgccctggcttcaagaggctgactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtttcatc

SEQ ID NO: 117619 - DNA, 669 bp, Homo sapiens
  Payload ID: 2980
  Gene Symbol: CSHL1
  Gene Name: chorionic somatomammotropin hormone-like 1
  Uniprot ID: Q14406
  ENST ID: ENST00000309894
  CDS Start-End: 1-669
atggctgcaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggagtttataagctcttggggaatggaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctag

SEQ ID NO: 117620 - DNA, 659 bp, Homo sapiens
  Payload ID: 2980
  Gene Symbol: CSHL1
  Gene Name: chorionic somatomammotropin hormone-like 1
  Uniprot ID: Q14406
  ENST ID: ENST00000346606
  CDS Start-End: 169-555
agcatcccaaggcccgactccccgcaccactcagggtcctgtggacagctcacctagcggcaatggctgcaggaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattg

SEQ ID NO: 117621 - DNA, 823 bp, Homo sapiens
  Payload ID: 2980
  Gene Symbol: CSHL1
  Gene Name: chorionic somatomammotropin hormone-like 1
  ENST ID: ENST00000392824
  CDS Start-End: 63-716
aggatcccaaggcccaactccccgaaccactcagggtcctgtggacagctcacctagctgcaatggctacaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggagtttgaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgttt

SEQ ID NO: 117622 - DNA, 566 bp, Homo sapiens
  Payload ID: 2980
  Gene Symbol: CSHL1
  Gene Name: chorionic somatomammotropin hormone-like 1
  Uniprot ID: Q14406
  ENST ID: ENST00000438387
  CDS Start-End: 41-460
cgcaccactcagggtcctgtggacagctcacctagcggcaatggctgcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtt

SEQ ID NO: 117623 - DNA, 973 bp, Homo sapiens
  Payload ID: 2980
  Gene Symbol: CSHL1
  Gene Name: chorionic somatomammotropin hormone-like 1
  ENST ID: ENST00000450719
  CDS Start-End: 239-742
gaaacaggtgggggcaacagcgagagagaaggggccagggtataaaaagggcccacaagagaccagctccagcatcccaaggcccgactccccgcaccactcagggtcctgtggacagctcacctagcggcaatggctgcaggaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatgggggtgagggtggcaccaggggtccccaatcctggaagcccactggcttcgagggctgggggagagaaacactgctgccctcttttcagcagtcaggcgctgacccaagagaactcaccttattcttcatttcccctcgtgaatcctccaggcctttctctacaccctgaaggggaaggaggaaaatggataaatgagagagggagggaacagtgcccaagcgcttggtctctccttctcttgcttcactttgcagaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaa

SEQ ID NO: 117624 - DNA, 880 bp, Homo sapiens
  Payload ID: 2980
  Gene Symbol: CSHL1
  Gene Name: chorionic somatomammotropin hormone-like 1
  ENST ID: ENST00000561003
  CDS Start-End: 94-630
gtataaaaagggcccacaagagaccagctccagcatcccaaggcccgactccccgcaccactcagggtcctgtggacagctcacctagcggcaatggctgcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatgggggtgagggtggcaccaggggtccccaatcctggaagcccactggcttcgagggctgggggagagaaacactgctgccctcttttcagcagtcaggcgctgacccaagagaactcaccttattcttcatttcccctcgtgaatcctccaggcctttctctacaccctgaaggggaaggaggaaaatggataaatgagagagggagggaacagtgcccaagcgcttggtctctccttctcttgcttcactttgcagaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtttcatctga

SEQ ID NO: 117625 - DNA, 760 bp, Homo sapiens
  Payload ID: 2980
  Gene Symbol: CSHL1
  Gene Name: chorionic somatomammotropin hormone-like 1
  ENST ID: ENST00000611417
  CDS Start-End: 1-654
ttctccccaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggaggttgaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtt

SEQ ID NO: 117626 - DNA, 5442 bp, Homo sapiens
  Payload ID: 2981
  Gene Symbol: CHM
  Gene Name: choroideremia (Rab escort protein 1)
  Uniprot ID: P24386
  ENST ID: ENST00000357749
  CDS Start-End: 31-1992
taatagtcacatgacacgtttcccgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccagtcaggatttgcatgaagatgtcgaagaagctggtgcactgcagaaaaatcatgctcttgtgacatctgcaaactccacagaagctgcagattctgccttcctgcctacggaggatgagtcattaagcactatgagctgtgaaatgctcacagaacaaactccaagcagcgatccagagaatgcgctagaagtaaatggtgctgaagtgacaggggaaaaagaaaaccattgtgatgataaaacttgtgtgccatcaacttcagcagaagacatgagtgaaaatgtgcctatagcagaagataccacagagcaaccaaagaaaaacagaattacttactcacaaattattaaagaaggcaggagatttaatattgatttagtatcaaagctgctgtattctcgaggattactaattgatcttctaatcaaatctaatgttagtcgatatgcagagtttaaaaatattaccaggattcttgcatttcgagaaggacgagtggaacaggttccgtgttccagagcagatgtctttaatagcaaacaacttactatggtagaaaagcgaatgctaatgaaatttcttacattttgtatggaatatgagaaatatcctgatgaatataaaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatttttacgaataagtcagtagtgttttttagtatcagtagtgatatttgtttgtaaattatttacatattgggaaaggtcaataatgaagaaatgaaagaatggaaggaaaggtgtggataggctcattggtatttgaatattctgtctgtcaagtaactagagtattaggctaattgtctacagacctaatttaatcctggctgtcctactgatgatatttggtaaattgtttaacttctgagcctacgtttctccatatataaagtggaaatagtattactatgcctactatatgagaatggttatgaagacaatgcaatgccatgtttagaatcggtttgccagaagaaaattgttttagaattttcccattgacttgatgaatctcaaaagtctcacgcaggaaataattgcttgctgtcagtcaacttccaaacaaaatagatcacagtgtttttattgcattaagctttttaaatgaaaatttcttttttaaagtagtattttatagtcttacagaccagtaaaaatagtaacaagtagaattgtggttttgaaatattactaaggaaaacactctataaattgttttattccttttctggtaggtaaacctgcaaccaccaaggactccaaattgtgtatgacagttggtaagccctaatatacactacataaaaacgttagggctgcctgtaatcccagcactttgggaagctgaggtgggtagatcacttgaggtcaggagttcgagaccagcctggccaacatggcgaaaccctgtctctactaaaaatacaaaattttagctgggtgttatggtgggcacctgtaatcccagctactttgaagatgaggtagcagactcacttgaaccagggaggcggaggttgcagtgagccaagattttgccactgcactccagcctgggtgacagagcaagactctgtctcacaaaaaaaaaaaaagggggctgtacataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaacccagctggggcatatgcactcaatgtctaatacatacttattaatgtaccggatattggccttgcccctggatatcagcaatatattataaaaggttccagtagatgagacgattgagtctgaatacaattgcagtaaattgtgccaataaagatattgtactgttacggtcttagagttaaagccgcttgaatgcagcatgcacattcatgtaaacagacaatcagggtaggcctagaataaccacaaaaattctattggccttactgcagccacctatatgtagaacaatggaggagatagtttgtggtccattattgtaccctgtttcatccattagcatcagaatctctctttcaggtcatttattaaatatgattgaaatgtttaaaagttcctgaacatgattcatgatgattaaaatatcatacaactgataaaagactttaagaactttatatatttcctgttgcctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttca

SEQ ID NO: 117627 - DNA, 2821 bp, Homo sapiens
  Payload ID: 2981
  Gene Symbol: CHM
  Gene Name: choroideremia (Rab escort protein 1)
  Uniprot ID: P24386
  ENST ID: ENST00000615443
  CDS Start-End: 8-340
cgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccaggtccacgctgcttttatgagctgtaacactcaccgcgaagatctgcagcttcactcctgcgcccaccgagaccacaagcccaccgggaggaacgaacaactccagacgctctgccttaagagctgtaacattcaccgcgaaggtctgcagcttcactcctgagccagcgagaccacgaacccaccagaaggaagaaactccgaacacatctgaacatcagaaggaacaaactccagacgtgccaccttaagagctgtaacactcaccgcgcgggtccgcggcttcattctttaagtcagtgagaccaagaacccaccaattccggacacaccgatagcattctaatattttacatttgattgcaaggaggactaggcgagaattcaaatggattagtgcaaacccattaccactgcttggaaaatacgtcaaagtatttgggcaatataattctaatatatgtattctaatataaatatatagggtgtatttatatattatgtattctaatataaatatataggatagttattttttgattaccatgacttatttaaaaagtattctgaagtattattcaacttaaaggttttcatgatcatttcaacattaaatttaatacgttgggtattgcaaaacaggctaaagactaaaatgtaaattgtagtaattattctatcataggctaggttcaaacatcatagactgtaaagaactatccagattgttttatcagagctttgttttcctgattcttccttacaataagtgggctacttaatattttggacctaaaatatttttgctacacaaagattgtttttcattgaagtgattttttgtgattacacaatcgagttatggaagggaaatgaaaaaggactagtgtttattggatattatctttgtggcaactgctgtaacctgttgctttacatattaatttcatttattctgtgcagcagtcatgtgcatgagctataggtacatcttactgacaaacagaagctcaaggaatgctagagatagcagagccaaatttgaacttgtgtttttctaactcaaaaacgtgtgctatttccagtgtatcatgttgtatttcagtcatcaggtaaacacatgtatgcacatcaagggaaccaaccgttccaccaagtgaattaagtatttcctttgtgaagactagcacctaagaaagtgcatttacttctttaatttactggaatactatatagtattgtaatgtagttatatctgtaatgagaaattaaagtgcctaactcccagtgttaggaagctatgggaagaatccaatattctttagttgttgagaccagtttatatgccatgggattttttaaattgatacataataattgtatatattcatgggatacaatatgttttggtacatataaacattgtagaatgatcaaattaggctaattagcatatccatcaccttaaacctttattattttttgtgagaacattcagaatcatctcttttagctatttgaaatatgcaatgcattattgttagctatactcaccttactgtgtgatagagtaccagaatgtattcctcctacctaactgtaacattatacccattgaccaacctctcctcatcttcccctccctcctgttctccccagtctctggtaaccactatcaagttttttagatttcacatatgagtgagatcattcagtatttttctttctgttctcagcttatttcacttaatataatgttctccaggctcatccatgttgtcacaaatgacaggatttaattttttttatggctgtgcagtattctattgtgtatatatgccacattttccttgttaattcatttgttgatgggcatttaagttgattccatattttcgcaattgtgaatagtgctccaataaacatgggagtgcagatgtctcttcaacctactgatttcatttcctttggctatatacccagtagtgagggtgaagattgctggatcatatgatagatttatttttaattttttgaggaacttctgtactgttttccataatggctgtactgatttgcattcctaccaacagtgtgtgagagttcttctttcttaccatgtaatagtttcatagtttatgtggggaaataaaagtagctattgtttctagttttagatcttgaacagactataaaaaggtgcaatatattaattcacacttaaatcacacaaactcaagttattcttaggtaaaatatcgttgcttgttaattgcataaagtcatctagtttctttagtgagaagagattttatctttctaaaatattaacaatagctttatacattttctgtcctattttctgcattgtactgaacgttgtttccctttttctggtataatattaaagcaggatgaaaacttatttgttaccttcaaatgaaccaactctaatgtattcataccaaaaataaagatttttttgcaataggaatctaaaa

SEQ ID NO: 117628 - DNA, 7078 bp, Homo sapiens
  Payload ID: 2982
  Gene Symbol: CHML
  Gene Name: choroideremia-like (Rab escort protein 2)
  Uniprot ID: P26374
  ENST ID: ENST00000366553
  CDS Start-End: 165-2135
ataagaaaaaaaatattttaaaagggtaaccgttaaacagctaggacctgcaacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtggtcagagggttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagctttttgctacgccagtcaggatatggaggacaacgttgaagagattggtgctctgcagaaaaatccttctttgggggtgtctaataccttcactgaagttctggattctgcattacctgaagaaagccagttatcgtattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaaggagaaattccccagggtttctgtaggatgtgtgcagtttttggtggaatctattgtcttcgtcataaagtacaatgctttgtagtcgacaaagaatctggacgatgtaaagcaattatagatcactttggtcaaagaataaatgctaaatattttattgtggaagacagttacctttctgaggaaacatgctcaaatgtgcagtataagcagatctctagggcagtactcattacagatcagtctatactaaagacagatttagatcagcagacttccattctgatagttcctccagcagagccaggagcttgtgctgtacgggtcacagaattatgttcttcaaccatgacatgcatgaaggacacctatctggtacatttgacatgttcatcttctaaaacagcaagagaagacttagaatcagtggtgaagaaattattcactccgtatactgaaacagaaataaacgaggaagaacttacaaagccaagactcttgtgggctctttattttaatatgagagattcctcgggaatcagcagaagctcgtataatggcttgccttccaatgtttatgtctgctctgggcctgactgtggcctgggaaatgagcatgctgtcaagcaagctgaaacacttttccaggagatctttccaactgaagaattctgccctccacctccaaatccagaagacattatctttgatggtgatgataagcagccagaggctcctggaaccaataatgtagtaatggccaaactagaatcctctgaggaaagcaaaaacctagaaagcccagagaagcaccttcaaaattagaaaagagcaatctcgaaatgctgttttggacctccttcatggcatcagaattttctcatttaaaggacagtttcccatatgagtaattagaagtggttatatatgatgaatgctatgcagatgttgtctttaactctcagacattcagcattgaatatctttgttaacctatcaatgagtgatttattgattattgaacattttgtttagaatgggctatatgacccagaatcttaaaacagagttagctttattttagtattgggtatatatgtaagggttccatattagcaactcagcttaaaggtaatgtatttgctaatgatcttcagattttatctttgtctacagaacaattagtaatacccaagtaatattttaattacttttgcagctgttacagttgctgcggcctgttcgaatagtgaaacatacacaaatggtaaattatgtggatcttttgcatataatataaatgtatagacatggtggtaggaatagcaactaatacaaatgccaatatgataataaaatacatttgtctataatcgtttaaagattagctttgcatgatcctttatgcactgtgaaggtctgaagtttataatactcacttgacccttgtaactgatgaggcaatgatgccaccacagtattctaatttacaaaaagaattggagttcaattagtggttgtaaagctcattttggggaggttgattgcaaaggaaatttgaaagataagatttattcttatttaatacttcagaaaatttctgcagagccctgccctggcacttaaaatagcttccaataagtaacttagaccaaaaggaaaaatgaagtgccccaggagaagatacttcagaagggctgttctgaaattcctaaggaggaattcttaggaattcctaaggagaaacagagtgaggcctttttaacctgagattacagatacttataaaaccctctataaatagattacccaaggtttttcagtgagaatgaaacataccaccttgttggctctaccactttaattaatatcactataacataactgataggaatgaatcaaaggaggatttaccatgccctttcggttgtgtcccacttaacaaattgtgaagtaacaattttctgtaatctctcttgcctcttagctgttatccagagtatagaaactttttttctcccagagccacccaacgtcataaaactggtagtactctaatggtgaaaacctgtggagctgtcagaagacatgaacttgcttttcctctagtccagtttccattcttcagtcagagtatgatgatccctgtgacagtttttgctctgaaatagtatttatcatgtgtttggtacctagtattatgctttctcatgacagtttctcaacaatcctgtgaggcaaattcgcatgtaccctctgtattagtgtgttctcatgctgttgataaagacacacctgagatggtaatttgtaaagaaaaaggtttaatggactcacagttccatgtggctggggaggcctcacaatcatggtggaaggtgaaaggcacgtcttacatggcggtggacaagagagaatgagaactaagtgaaaagggaaacccttttaaaaccatcagatatcgtgagacttatttactaccatgagaacagtatgggggaaacaactccatgattcagttatctcccaccaggttcctcccacaacacgtgggaattataggagctacaattcaagatgagatttgagtgggaacacagccaaaccatatcaccttcaaagaagaaataagagaattattagtaatttgctcagaatctggtatgtggaagagccaacatggggacccagccttttgtgattctaaaacctttgatctttctactaacattcactgttagagagtgtaggcgctgcaggagaaagagaaagtgcccacgaaaattagtctagcattgccgggggtaaaaagcacacactggtcctgcagcttattgaatcagagaaatgtgaagataagatgaactaaacaaacatattttagagcatggatctcgaagcagaatttggctaaattttaacaaaatgttcttcagtaacacatctcatgatctgaagattgtgttacaaaaaatattatcaggccaaaatttgttcggaatacactaatttttgctcctctatatgtgaggaaaatgagactagacagatttaagtaattgacaacttacttaaagtagcaaagtcatggattgtattgacttttaaaaatatagtaaaagtcatatttaaactttatcctaaagtttaaatctaacagaacaactgaaatacttgaaatagacctataaaatagtaattaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttaaaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattggcaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaatgatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataagggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactg

SEQ ID NO: 117629 - DNA, 6220 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  Uniprot ID: Q494W8
  ENST ID: ENST00000299847
  CDS Start-End: 455-1693
caggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggacaggctccttttccgcgcccctcccgccggaggtgaggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacatcaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagccatctggctcactcatttctgggtaatgcacatgactttgtttgcactggaggaagatggaagcttgcgtgtgtgcggtgtgtgtgtgtgtgtaagtgtgaggtaccttgtgtgtgacaagagacctcacttacgagaaagttggtggatcaggacattccagcctcaggcggcttggagcaggatcattcctcagcaggcattccttccacatgctatggatgaaccatgcacaagattttcggttttttttttctgttttgatatataaaaggaatgcttcatttcttatcattatcccaaaattgatccctcccacatttttgctttaaaaagaaacctttttggttttgtattttatacaggaacacaaaatgcaaacaagttgtgcatattttggactctcaaataactactctgtcctttaataaagtaataataaggaatagatgtgcacatagttagaaaagtatgagtggttaaaaacaacagtctcccatactgcctgttttctctctcagaggggaccactaatgagcttctaagggcatttctagaaaggaagaaaagaagataagaggccaaagaaggagggacgggggttatggagagagaccttccctttccagcactaacgctctgtgaagggcgctgcaccttgcattcttcatgtggtgttttgtcttagaggtcgtcccataataacatataaagatctacctcattcctcctagtagctgcttagcattccattatctcagcggactatcatttatttgaatagccttttattggtgaacatatggatacttccagtttttatttttatatacaaatctataattggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgcattttcttctgaaactttatggttttattggtttaccttcacatcttcagactccctggaattcatttgttgcaggacatgagggaaaaatccatactttttcctcgaaatggtggtcagcagtatcaataaatatgtaataatgcatttctaaaatacagtcatagtgttttccccagttgttcaaaatgcagccttatttgtaaactaaatttctttaagtgtttggttctgtttctgttctatttatctctatgaatgcctttcatttctaaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcactaaggtgctttgaatttatagtttatttctagatgttttatcatttggctatcattttcaatggaatgatttattccactttattttctattttatcccattgtataagaaagtagttggtttttatgtatgaatgttataatcaaccacaaattgtgattcctacttgtttctaaggtatacttttgacttctcctttccaatgtgtctcttatttctttcttgtatctagttgatttgagatcagtgttgagtcacagtgattcaggtggcatgcttatcttgttcgtgacatcagtgggacgttttaatgtctcagcgtttaacttgtatgaagacatgtattttccttgccataataaaaaagtatctgtgtgttctcaaactattaagactctctggggaaaatgtagatgttagatttttgtcaaagccttctcagtgtccagagggattatcagaaggtcttttcctttgctctagtagtatgtttaattatattaatagaatacttaagaccaaatcattagtgtattcctgagatgttctttacttattagtatcatgactttggttatcaatatttataattaagattcatcattctacatcttgcttttatgtgttttttgtccagatttaactttatgctgacttaaaggaagaaatattataaaacaaaaacctctatattctacaatcatctattggttttggattattttctgcttaagtgtagaagaactagctggggctgtctgggcctgccgtggtatatttctggattttgctcatcaggcaagttaggtcctcgagcccttctagagtccattttaatgacatttttaaaaataaaattaattccatccacttttcaacata

SEQ ID NO: 117630 - DNA, 2794 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000397827
  CDS Start-End: 776-1741
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggacaggctccttttccgcgcccctcccgccggaggtgaggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaattccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacatcaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcag

SEQ ID NO: 117631 - DNA, 1913 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000401522
  CDS Start-End: 713-1678
ggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctgttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggt

SEQ ID NO: 117632 - DNA, 573 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000562729
  CDS Start-End: 261-573
ggttgtgccgcccagtcgcgagtgtgaggaagggaccagatcggtcgggcagaaaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggag

SEQ ID NO: 117633 - DNA, 2859 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000617299
  CDS Start-End: 567-1805
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggccgcggccatgacagcggctcgggactggctccttttccgcgcccctcccgccggaggtgaggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggtgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgttggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcag

SEQ ID NO: 117634 - DNA, 1913 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000618874
  CDS Start-End: 713-1678
ggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctgttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggtgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgttggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggt

SEQ ID NO: 117635 - DNA, 2795 bp, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENST ID: ENST00000620917
  CDS Start-End: 776-1741
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggccgcggccatgacagcggctcgggactggctccttttccgcgcccctcccgccggaggtgaggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaattccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggtgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgttggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcag

SEQ ID NO: 117636 - DNA, 2488 bp, Homo sapiens
  Payload ID: 2984
  Gene Symbol: CHRAC1
  Gene Name: chromatin accessibility complex 1
  Uniprot ID: Q9NRG0
  ENST ID: ENST00000220913
  CDS Start-End: 203-598
atgcgcagatcgggggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacggagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgtgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatattttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaatacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcctctcatttcattatctttttttttttttttttaaagacagattctcactcagttgcccaggctggattgcggtggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaagggccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatg

SEQ ID NO: 117637 - DNA, 1678 bp, Homo sapiens
  Payload ID: 2984
  Gene Symbol: CHRAC1
  Gene Name: chromatin accessibility complex 1
  ENST ID: ENST00000519533
  CDS Start-End: 190-360
gggcgcgaggcctcacggagctcgtagtttcccggacgggccgctcccggcctcgcggcctcgcctccccacactacaactcccacggggcagcgggcgcggctccccgtacccaccagctggccgggcagggcagccacttcgcggtcgggcccgccggctgcgggcacccgcgcgacgggcgggaagatggcggacgtggtcgtgggtaaagacaagggcggggagcagcggctcatctcgctgcctctatcccgcatccgggtcatcatgaagagctcccccgaggtgtccagcatcaaccaggaggcgttggtgctcacggccaaggccacgatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgtgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatattttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaatacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcctctcatttcattatctttttttttttttttttaaagacagattctcactcagttgcccaggctggattgcggtggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctctttttt

SEQ ID NO: 117638 - DNA, 811 bp, Homo sapiens
  Payload ID: 2984
  Gene Symbol: CHRAC1
  Gene Name: chromatin accessibility complex 1
  ENST ID: ENST00000519618
  CDS Start-End: 1-293
actgtcctcccgccgtttctctcgcgcttccattcggcaaacccgagctctttgttcaatgcctagccacctattcctacagacacggcagtggaaaggaaaagaaagtactgacttacagtgatttagcaaacactgcacagcaatcagaaacttttcagtttcttgcagatatattaccaaagaagattttagctagtaaatacctgaaaatgcttaaagaggaaaagagggaagaagatgaggagaatgacaatgataatgaaagtgaccatgatgaagctgactcctaaaccaaaagtgctttaaaaaccagcctggcgaggacagccctggacccactccactgtctctaagtaaacacagcactgcccgcttttagcgtcttcacttcttcacagagttccagtgtgtggtattctttcgaggtattctttccaggccgagattgagcacctcatgtacctacgccacagacagccagagggaaagcgacccagacagcagcccctcctcgacaggcccaccctgcagctcaggcaccaagaaaacagccgatactggcagccattgcagctccaaactgcagaggcaaggccaattttaacttttcaatttacagtcgattttgaagagcttctacatatcggttatgtaaattcatatatgtatattttggaatcagttcttataaacagctcgattcagttttagctaaatttatagtttaggtagtatgttacatttgaatttttgtcttaagaaaagttgactgttcagatatttttctactgtaaagaaatatactttt

SEQ ID NO: 117639 - DNA, 925 bp, Homo sapiens
  Payload ID: 2984
  Gene Symbol: CHRAC1
  Gene Name: chromatin accessibility complex 1
  ENST ID: ENST00000518971
  CDS Start-End: 1-243
tttgtcgccttccttcgctccgcccgccccttccttccgtgcgcaccttcgccccgcccaccccactgtcctcccgccgtttctctcgcgcttccattcggcaaacccgagctctttgttcaatgcctagccacctattcctacagacacggcagtggaaaggaaaagaaagtactgacttacagtgatttagcaaacactgcacagcaatcagaaacttttcagtttcttgcaggtacttagtctttgaaacattctggttaaaaaatgattagtaatcaatagctctttccccaccccttgcctcccttctgctctcacggaaaattagactttttgctactttttccaagccgcaaagtactatgagttgtcacaggaagatacttttagtcttctctgtttgaatgtgtttgtcatgtggtccacctagaacaatagtgaagccaacaacattcacaagatgttggttggccgcgtatgctgggcagtcctttactctctacagggaccctgcctgccactgaagggaaaactcagggtgggtctacatggccgtagttagagcttaagtctaccctggggctagcctaggctatctcaggtagtcgggcagggttgctcataaaagcagctcatagagacaccatggtttgtactcattggactggaaagaggcctatagcgttcgttaggagacaatgctagtttctttgatattttacccagaaatgcagcctgaatttcatcttgttttggaacctcttatagaggtcaaagcaggaactagtacattttgaaatgtgcattgctgtgttcatagtctaccataaccaattgctgatgtacgctttatgtttttaagatatattaccaaagaagattttagctagtaaatacctgaaaatgcttaaagaggaaaaga

SEQ ID NO: 117640 - DNA, 3339 bp, Homo sapiens
  Payload ID: 2985
  Gene Symbol: CHAF1A
  Gene Name: chromatin assembly factor 1, subunit A (p150)
  Uniprot ID: Q13111
  ENST ID: ENST00000301280
  CDS Start-End: 102-2972
ggcggcagcagcggcgcgggcgggagggcgaagagcagcggccgcctgaggggagcccgcgcctccgccgcctgagaggaggtcgagctgccgccggggcgatgctggaggagctggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgcggaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagc

SEQ ID NO: 117641 - DNA, 499 bp, Homo sapiens
  Payload ID: 2985
  Gene Symbol: CHAF1A
  Gene Name: chromatin assembly factor 1, subunit A (p150)
  ENST ID: ENST00000585854
  CDS Start-End: 47-499
cccgcgcctccgccgcctgagaggaggtcgagctgccgccggggcgatgctggaggagctggagtgcggggcgcccggcgccaggggagccgccacagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaag

SEQ ID NO: 117642 - DNA, 563 bp, Homo sapiens
  Payload ID: 2985
  Gene Symbol: CHAF1A
  Gene Name: chromatin assembly factor 1, subunit A (p150)
  ENST ID: ENST00000589648
  CDS Start-End: 1-144
gaagacatggacggcttccaggcagacacggaggaggaggaagaggaggagggcgactgtatgatcgtggatgtcccggatgctgcggccatgcgcagcctcttccagtctctctctgattcaccctcctgccacctcttgtgaggacactgggtcccggaccacccaggatcatctcccagctcaagacctttcatcatacccaagcccctcttgccaggtgaagttgcgcatctgcaggttccaggaataggatgtggccgtctcaggacaccctgtccctctggccacagggaagccaggcctgtgacagcactcgcctcccctgcagggactgggcctttgtgggcacagcacagcctcccctagcgcacgggacttcctccccaggtgggtggctcatcgggcacttgtggccaggtgctggcctgagaacaggtatccacatggtcccaccttgacagggagccacacccagcccccaagccatccgctcttcagcaggtgggcctgccctgtgtcccacggtttcaacggagaaccaagaaactatattcaaacaa

SEQ ID NO: 117643 - DNA, 884 bp, Homo sapiens
  Payload ID: 2985
  Gene Symbol: CHAF1A
  Gene Name: chromatin assembly factor 1, subunit A (p150)
  ENST ID: ENST00000585371
  CDS Start-End: 1-54
aaattcgtcaaaggctctacagagaagaacaagctcagactgcaaagaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacaggcctctctccacctggccttcctgtaagctcctgaagtcttcctctccctgtcttcccagctcctcgtggaggaatcttatttccctgctggtctccagtgaaggataccccccaacacctcgctcttgcaaatctcattccacagaacctcccttgctaaaaatgctctggggctgcacctgggcagctgtcctccctctcaccctgcaggctgcaccctcctccatctgtcccttcagtccatgttcctgacctttctttggggacaggcagtgctgctttttaacaaatgcccatctttctagaattgttaggccagcttcacagggaggttcctgggaggtttgtgagcaggtctgtaaggcagcgtgatcctgagcctggggttttccttctcagtgatgtcgtcatcgtggagcgtgggaagggcgacggtgttcccgagaggaggaagtttggcaggatgaagctcctgcag

SEQ ID NO: 117644 - DNA, 875 bp, Homo sapiens
  Payload ID: 2985
  Gene Symbol: CHAF1A
  Gene Name: chromatin assembly factor 1, subunit A (p150)
  ENST ID: ENST00000587739
  CDS Start-End: 1-875
atgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttc

SEQ ID NO: 117645 - DNA, 4480 bp, Homo sapiens
  Payload ID: 2986
  Gene Symbol: CHAF1B
  Gene Name: chromatin assembly factor 1, subunit B (p60)
  Uniprot ID: Q13112
  ENST ID: ENST00000314103
  CDS Start-End: 152-1831
ggcctgcggcgcgcgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggtagttgtgtttgttttctgattttaaaggtgacgatgcttattcttttagtaactaagtgaagtgaaaaagatgggtatcacccatcatcttcccaccagaagtaaccctcgttaatgttgtagtatatttccttagcatttttgtggatctatttattctaaaaagagaattgagattttatttcatatgcaatttggtatctaaataggttagttttttagattggtttttcaaagcaaaaaaagtatcttttttgttttttgagacagggtcttgctctgttgcccaggctggagtgcagtggcgctatctcagctcactgcagcctcgacctcctgggctcgagcgatccttccacctcagcttcccgagtagctgggactacaggcatgtgccaccatgccatgctaatttcacacacacatgcacccacacacacacatatatatgatacatatatatatatatacacacacacacaagtatgtgtgtatatatatattttttttcttttttttttgagatggagtctcactctgtcgcccaggctggagtacagtggcacaatctcggctcactataacctccgcctcctgggttcaaacgattctcctgcctctgcctcttgagtagctaggattacaggtgtgtgccaccacatccggctaatttttatatttttagtagagatggggttttgccatgttggccaagctggtctctaactcctgacctcagatgatctgcctgcctcggcctcccaaagtgttgggattacaggtgtgagctactgcacctggcctaattattatatttttaggggagacggggtttttccatgttgcccaggctggtctcgaactcctggggctcaagtaatcctccctccccagcctcccaaagtgttgggattacaggcgtgagacaccatgcctggtcaaatggtatctgttttgacgggtggttctcaactgtagctgcatactgaaatcacctaagagctgacataccagtgcctgggttcccgcttcggaggatttggcctaatcggtctggggtatgttctgaatattaggatttcttaaagctcctggagtaattctgatgcgcagccaagattgagaaatctaagggaaaaaactttccctggatacggtctgttctggttaaatgcatttccactgaaagcatttttttttttttccgagacagagtctcgctctgtcacccaggctggagtgcagtggcgcaatctccactcactgcaacctcacctcctaggttcaagggattctcctgcctcagcctctccagtagctgggattacaggcacccgccaccacgcccggctaatttttgtatttttagtagagatggtgtttcaccatgttggtcaggctggtctccaacgcctgacctcgtgatctgcccacctcagcctcccaaagtgctgggattacaggcgtgagccaccgcgcccagccgaaagcattttcttgattatctctgccccgtcactgattgacatcctcctttgctggggccgcggactgaaggacagtatgcaggaggtgccatcagctcttctgaaaagagacagctttcagtgtcatgtggctggcgtgaggtgcggtttgcagttgttgatcctgtgcagacagatgaatgaccatgggtcccctgtccttattgagcagcctgcttcctggccatacctggggaggaacagtattaggtttttctgggtgtggtggctcacacctgtaatcccagcactttgggaggccaaggtgggtggatcacttgaggttgggagtttgagaccagcctggccaacatggtggaaccccatctctactaaaaatacaaaaactagccaggcgcggtggcacacacttgtaatcccagctactcgggaggctgaggcacaagaatcgcttgaacccgggaggcggagtttgtagtgagctgagatggtgccactgtactccagcctgggcgacagagcgagactctgtctcaaaaaaaaaaaaaaagagaaaaagaagaacagtattaggttttacaaatctgtttcttgtgcattgattgtgggagttggggtgggggacccctgatggcctgcctgttctcagccatcatccttaaatataaatcaaaattggcaataaaagaccaagtgaagtca

SEQ ID NO: 117646 - DNA, 3240 bp, Homo sapiens
  Payload ID: 2987
  Gene Symbol: CDT1
  Gene Name: chromatin licensing and DNA replication factor 1
  Uniprot ID: Q9H211
  ENST ID: ENST00000301019
  CDS Start-End: 620-2260
ttttgtatttttagtagagacggggtttcaccgtgttagccaggatggtctcgatctcctgacctcatgatccgcccgcctcggcctcccaaagtactgggattacaggcgtgagccaccgcgcccagccagaaatagttttaaaaaaagaaataaggagcgtgcggcccgcgggggaagcgcctttaccagctcgagcctgcagccccccaggccgcgccgtcctcggctcccccgggcagcgccggggttttgtcaggcgcgcgctgctgtttgcctggattgcgctcattctgaccctgaagccagcggccccactgacacgccctgaaaagtgggagccacacgcgggatccggagaccgcgctaaagtcccacgcacgacggcgcccgccggcgagtccacgcccgcacgtcggcgcatgcgcgcggccaagccggtgcccgcgcccaccagcgcgcatgcgcgccccgtcccttccctccccccgtgctctgccccgatggttcggtccgcgccgggggcggggccagggcgcccgcgggaaatttggcgggaaccgcgcccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccacta

SEQ ID NO: 117647 - DNA, 571 bp, Homo sapiens
  Payload ID: 2987
  Gene Symbol: CDT1
  Gene Name: chromatin licensing and DNA replication factor 1
  ENST ID: ENST00000569140
  CDS Start-End: 1-571
cggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagca

SEQ ID NO: 117648 - DNA, 2250 bp, Homo sapiens
  Payload ID: 2988
  Gene Symbol: CHTOP
  Gene Name: chromatin target of PRMT1
  ENST ID: ENST00000368686
  CDS Start-End: 9-314
gggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggaaaaagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttccaaaaatggatttgtggtcagacttgttgaattgattgaataaagagtagcttaatctgttcacagtatgcagcttgccccagccaacctaaaaactaactgaattaccttcatttaaccctcaccgccttcctttggttagaatctactttgtgtctcttggatttacctgcatatacattgtatgcctcctctctaaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggttagtcagctaccaacttcagagagtagctcccccttactttcctcccttaaaaactcagagccacctttctgcacagcttcaagtcataggcaggcttctttgtttgtcttgttttgttatttgaaactggcttatttttcaaattaccatgctggtagtgcaaaagtctcatgatttttccaagaatcaatcaagtgcatattatagagccagattatatgccatcttcctccaagctcttgcaaatttaaattgtatagttgaaaataccccccaaaatggtcagtttagggttttgcctttctctgcccctgtcccaccaccatcaccaccacataccaccctgtagctccaaatcctggtttgagtcacatgagaatatagaagagagagagagatacaaagatgaagtagagttaagagggtggtgagacttggagctgggcattggctctgaaaccaaataaattcaatgtcacatttggtgcctgtggagaaccagagatgactttttttgcttaaggtagagagcaagatggaattattatcagttaactaactggctcttattgataatcttgcctttgaaatttattgatgtttgtcttgtgacctcatgacccagattgggaaagagtttaatgatgttgctgctgttaatactaaatctcatgggagccttctggtttagagcttagtggaaaactcccaacacctgtccagaaaaaaaacactattgaagcccctgtgtatatttgctttggttctcttaaaaggtgtcttgggtcttccataacttatgaccttgaagttgccaaggaataataactgttaggaaagaaaagttgataaccaagggcttgttttcttctctcccattatatgatacttactgagtgaagtgcaagctagtttgggtttcaggatgaaataacatgtttccaaattatcttgacttggatcctgagagacatcacgagggtgggagagactaaaatagcttttcaaaaagctgagt

SEQ ID NO: 117649 - DNA, 1094 bp, Homo sapiens
  Payload ID: 2988
  Gene Symbol: CHTOP
  Gene Name: chromatin target of PRMT1
  ENST ID: ENST00000368687
  CDS Start-End: 222-893
gtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttg

SEQ ID NO: 117650 - DNA, 2165 bp, Homo sapiens
  Payload ID: 2988
  Gene Symbol: CHTOP
  Gene Name: chromatin target of PRMT1
  Uniprot ID: Q9Y3Y2
  ENST ID: ENST00000368690
  CDS Start-End: 380-1129
tttcccgccctctagtcgtgcgcggatctgacgcctgacgtaattgcgtagacgccattttagccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatcc

SEQ ID NO: 117651 - DNA, 2096 bp, Homo sapiens
  Payload ID: 2988
  Gene Symbol: CHTOP
  Gene Name: chromatin target of PRMT1
  Uniprot ID: Q9Y3Y2
  ENST ID: ENST00000368694
  CDS Start-End: 313-1059
tcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatcca

SEQ ID NO: 117652 - DNA, 1923 bp, Homo sapiens
  Payload ID: 2988
  Gene Symbol: CHTOP
  Gene Name: chromatin target of PRMT1
  Uniprot ID: Q9Y3Y2
  ENST ID: ENST00000403433
  CDS Start-End: 282-890
gttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaa

SEQ ID NO: 117653 - DNA, 1840 bp, Homo sapiens
  Payload ID: 2988
  Gene Symbol: CHTOP
  Gene Name: chromatin target of PRMT1
  ENST ID: ENST00000614256
  CDS Start-End: 380-610
tttcccgccctctagtcgtgcgcggatctgacgcctgacgtaattgcgtagacgccattttagccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatcc

SEQ ID NO: 117654 - DNA, 2232 bp, Homo sapiens
  Payload ID: 2989
  Gene Symbol: CBX1
  Gene Name: chromobox homolog 1
  Uniprot ID: P83916
  ENST ID: ENST00000225603
  CDS Start-End: 292-849
gaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagcagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctga

SEQ ID NO: 117655 - DNA, 2422 bp, Homo sapiens
  Payload ID: 2989
  Gene Symbol: CBX1
  Gene Name: chromobox homolog 1
  Uniprot ID: P83916
  ENST ID: ENST00000393408
  CDS Start-End: 482-1039
gtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctga

SEQ ID NO: 117656 - DNA, 578 bp, Homo sapiens
  Payload ID: 2989
  Gene Symbol: CBX1
  Gene Name: chromobox homolog 1
  ENST ID: ENST00000402583
  CDS Start-End: 73-578
ccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagaggtaagaatagaatcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatga

SEQ ID NO: 117657 - DNA, 544 bp, Homo sapiens
  Payload ID: 2989
  Gene Symbol: CBX1
  Gene Name: chromobox homolog 1
  ENST ID: ENST00000444685
  CDS Start-End: 215-544
gccgcccttgcatcctgatgggtccttacagtggggaggctgtaagaataattcaagttttccatctggaaagcatttgcttcgcaaacagccacagcttacagactacaagcagtttagaaacaagactaccacctgaatatactacacatgccttcacctgccttttgatgattgcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagcca

SEQ ID NO: 117658 - DNA, 812 bp, Homo sapiens
  Payload ID: 2989
  Gene Symbol: CBX1
  Gene Name: chromobox homolog 1
  ENST ID: ENST00000581003
  CDS Start-End: 292-812
ctgcggccacccggcttgctgccttcctgggcgccactcccccaggcgacccgacgcgacgcgccagcagcgcagcaccgattcctctcgggctcttgggcgctgctctgagacggaggctcacactgtctcccaggctggagtgcagtggcgcgatcttggcacactgtaacctccacctcccaggttgtagcaattcttctgcctctgcctcccaagtagctaggattacaggcgcctgccaccacgcccagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctaccc

SEQ ID NO: 117659 - DNA, 550 bp, Homo sapiens
  Payload ID: 2989
  Gene Symbol: CBX1
  Gene Name: chromobox homolog 1
  ENST ID: ENST00000495350
  CDS Start-End: 58-474
ctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggtgagtcggccagtggctctgtgtggttgttttttttcttctcccattggtttcatgccagaggaaaagagctggacctt

SEQ ID NO: 117660 - DNA, 1061 bp, Homo sapiens
  Payload ID: 2990
  Gene Symbol: CBX2
  Gene Name: chromobox homolog 2
  Uniprot ID: Q14781
  ENST ID: ENST00000269399
  CDS Start-End: 43-678
gactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggtgggtggctgcgctgggtatgctgaccccacctcccagcacccccttggcgtagggggcaggcagagggagggtttggggccctcaggaagggggtggcacttctgccaacagtctgtccctctactcggaaaacaggagccccctttcttcctgtctctcagcttctgctgccaggggccccagccggctgagagttcctccccgcccctcccaggggcttcctgcttcagcctgtcctgcacgcctctctgctgggtggcagggtcaaactgctgcagacaagcactcttccctcccagggggtccttgggggacggaaaggaacaggaagcatgcgtacagtaggtgctcataggattgccggctggatgtgactcaaaagcctaagatttgggggctactccgggcccacctgcgggtgcaccttaaatcgaggtggccacgaaaggcagggctgactgaatagccagggggtgccaggaggggccttggaggagggcagaggcagtgtgggctgatgatgtgctttggccttctcgggactgtcctgtcacccctcctcgctacagtgatgggctcaccccgccacaggtatgcatgcgcccctggggtccgtggtagggcccctccctcccctgaggacaggtgaggcaggacaggatgggggaggagggcctggcctcagtcccgggtgtggctttgattccctcctccgggcactgtccctg

SEQ ID NO: 117661 - DNA, 4644 bp, Homo sapiens
  Payload ID: 2990
  Gene Symbol: CBX2
  Gene Name: chromobox homolog 2
  Uniprot ID: Q14781
  ENST ID: ENST00000310942
  CDS Start-End: 105-1703
ggcgccgggcgggggcggtgctttgtgtgctgccggcggggcgcgcggcggtccgggcgggtgactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctggcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttctaa

SEQ ID NO: 117662 - DNA, 2128 bp, Homo sapiens
  Payload ID: 2991
  Gene Symbol: CBX3
  Gene Name: chromobox homolog 3
  Uniprot ID: Q13185
  ENST ID: ENST00000337620
  CDS Start-End: 429-980
agccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaa

SEQ ID NO: 117663 - DNA, 1857 bp, Homo sapiens
  Payload ID: 2991
  Gene Symbol: CBX3
  Gene Name: chromobox homolog 3
  Uniprot ID: Q13185
  ENST ID: ENST00000396386
  CDS Start-End: 163-714
ggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 117664 - DNA, 1717 bp, Homo sapiens
  Payload ID: 2991
  Gene Symbol: CBX3
  Gene Name: chromobox homolog 3
  ENST ID: ENST00000409747
  CDS Start-End: 91-396
gtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagaaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaa

SEQ ID NO: 117665 - DNA, 1068 bp, Homo sapiens
  Payload ID: 2991
  Gene Symbol: CBX3
  Gene Name: chromobox homolog 3
  ENST ID: ENST00000456948
  CDS Start-End: 882-1068
cttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgtttaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaac

SEQ ID NO: 117666 - DNA, 949 bp, Homo sapiens
  Payload ID: 2991
  Gene Symbol: CBX3
  Gene Name: chromobox homolog 3
  ENST ID: ENST00000462165
  CDS Start-End: 1-324
caaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaagtggggtaggtccatcattctcacccaggcagtgtgactccagagcttgtgacattgatgtaaaactctgacaggaataaaggatttattgatatc

SEQ ID NO: 117667 - DNA, 2664 bp, Homo sapiens
  Payload ID: 2992
  Gene Symbol: CBX4
  Gene Name: chromobox homolog 4
  Uniprot ID: O00257
  ENST ID: ENST00000269397
  CDS Start-End: 179-1861
cgagcgcgagccgggagccggggcgggcgcgggcagcggcgggccggccgggctgtgcggggcgagcggcggcggcggcgggggcgcttcggccggggcggcagctgggcgccggcgggagctagcagcgtctgcagccgcgccggccgccagcgccccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctgcgtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgca

SEQ ID NO: 117668 - DNA, 718 bp, Homo sapiens
  Payload ID: 2992
  Gene Symbol: CBX4
  Gene Name: chromobox homolog 4
  ENST ID: ENST00000448310
  CDS Start-End: 137-319
gccggccgggctgtgcggggcgagcggcggcggcggcgggggcgcttcggccggggcggcagctgggcgccggcgggagctagcagcgtctgcagccgcgccggccgccagcgccccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgc

SEQ ID NO: 117669 - DNA, 490 bp, Homo sapiens
  Payload ID: 2992
  Gene Symbol: CBX4
  Gene Name: chromobox homolog 4
  ENST ID: ENST00000495122
  CDS Start-End: 1-271
ggagaacatcctggaccccaggctgctgatcgccttccagaacagggaacggcaggagcagctgatgggatatcggaagagagggccgaagcccaaaccgctagtggtgcagacctcccacctcctgccccccatgaggcagctgcggacctggtgggggctgggacgctccagaaactcccggcatgcggtggggctgtctcctccctcctctcacccctgcacccgttccctcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgacccca

SEQ ID NO: 117670 - DNA, 11528 bp, Homo sapiens
  Payload ID: 2993
  Gene Symbol: CBX5
  Gene Name: chromobox homolog 5
  Uniprot ID: P45973
  ENST ID: ENST00000209875
  CDS Start-End: 138-713
ttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgaggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccgttagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattgaaccttttttttttttttttttttttttttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgcttttcaaatatgga

SEQ ID NO: 117671 - DNA, 1832 bp, Homo sapiens
  Payload ID: 2993
  Gene Symbol: CBX5
  Gene Name: chromobox homolog 5
  Uniprot ID: P45973
  ENST ID: ENST00000439541
  CDS Start-End: 127-702
agctgccagcccgccaagacccagacctgggaggggaggcccctcctgttagcccagagggaaagaaagaactggggcgatccgggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctc

SEQ ID NO: 117672 - DNA, 894 bp, Homo sapiens
  Payload ID: 2993
  Gene Symbol: CBX5
  Gene Name: chromobox homolog 5
  Uniprot ID: P45973
  ENST ID: ENST00000550411
  CDS Start-End: 319-894
gttagcccagagggaaagaaagaactggggcgatccggtaggtaaaggagggaacccccattcattttctacctttggggctcctcttctgcatgaaggtataaagggagattttccttgtctctccctcaaaatgaagaacacatgtaaatccttgtttttcctggtgaggcaggggaggccatagccacaatgcttaactgcatgcatctaacatggggctggttttaaccccagcgctctgacctaaactgctcagctcccggaaattccaagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaa

SEQ ID NO: 117673 - DNA, 675 bp, Homo sapiens
  Payload ID: 2993
  Gene Symbol: CBX5
  Gene Name: chromobox homolog 5
  ENST ID: ENST00000552562
  CDS Start-End: 402-675
agttgcatcttgggaattactgaataatctagtgactaattttgaattttaggactgaaaaattttttctcctttctgcctccctcccatccccaaattagctttctaaaaaggaagattagtgtgtttgagatgtcagccttgcttttgtgagctgatggatgctctgaagggacaagctcaatttgtttaagggaaatgtaccaagtcactgaaaatgtggtgaaaggtgcctaagcaagccttttttgtgtgctgctaagagactgggcaagatgctcagagcacagaaaactcatattttagtggcttttcttttttcatttttataaagacgcttattcaccttggagaaaaagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaat

SEQ ID NO: 117674 - DNA, 3191 bp, Homo sapiens
  Payload ID: 2994
  Gene Symbol: CBX6
  Gene Name: chromobox homolog 6
  ENST ID: ENST00000216083
  CDS Start-End: 27-1211
atgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaa

SEQ ID NO: 117675 - DNA, 6122 bp, Homo sapiens
  Payload ID: 2994
  Gene Symbol: CBX6
  Gene Name: chromobox homolog 6
  Uniprot ID: O95503
  ENST ID: ENST00000407418
  CDS Start-End: 125-1363
cgcgagcgcgcgccccgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccgggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagccccta

SEQ ID NO: 117676 - DNA, 4081 bp, Homo sapiens
  Payload ID: 2995
  Gene Symbol: CBX7
  Gene Name: chromobox homolog 7
  Uniprot ID: O95931
  ENST ID: ENST00000216133
  CDS Start-End: 207-962
ccgaggaaaacgttgcgcaggttcaaaaatggaacgtcggcggcgtgagggagcgcgagggggtgtgcgcgcgtgcgcgtgcgcgtgcgcgcccggacgagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaaggaggagagagaccgagcatcggggtataggaagagaggtccgaaacccaagcggcttctgctgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaa

SEQ ID NO: 117677 - DNA, 784 bp, Homo sapiens
  Payload ID: 2995
  Gene Symbol: CBX7
  Gene Name: chromobox homolog 7
  ENST ID: ENST00000401405
  CDS Start-End: 1-477
atggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaaggaggagagagaccgagcatcggggtataggaagagaggtccgaaacccaagcggcttctgctgcaggagccaccggccccagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctgg

SEQ ID NO: 117678 - DNA, 472 bp, Homo sapiens
  Payload ID: 2995
  Gene Symbol: CBX7
  Gene Name: chromobox homolog 7
  ENST ID: ENST00000434260
  CDS Start-End: 109-472
gagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaaggaggagagagaccgagcatcggggtataggaagagaggtccgaaacccaagcggcttctgctgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaa

SEQ ID NO: 117679 - DNA, 3791 bp, Homo sapiens
  Payload ID: 2996
  Gene Symbol: CBX8
  Gene Name: chromobox homolog 8
  Uniprot ID: Q9HC52
  ENST ID: ENST00000269385
  CDS Start-End: 119-1288
gagagcgccgggagggggaggagaactgacgtcagcgggagagtattatggtctgtcgtgcgctggctgctgcttttctgctcctggaagcggccaaggggggaagcggcgagtcaacatggagctttcagcggtgggggagcgggtgttcgcggccgaagccctcctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctggggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagactctcattgtgctttagttggggcagcccgaatgagctggggcaggaggggcccccttgccccagagctctagggaagttgggccctgggtacaggtttctgagagtgtctggaggggcttggcctgcccacctcacccctcctcccttctcccacagcccaatgccagactcctggcaccaaggcccggcccagatttgctctctcttcccattggccaggcaggccaacaaaaggttggctccccaatcagaaaaaagggggggtggggtcagtctgttttccttttttctatttttttttttttaaggtaaagaagtctattagggaaaaaagtattaacttgaataagcttttcgtgtgtgatgttgaaggttaaaacgtccccagcaggcagggacaggaggtttctccccaggaccacaccaggaaatgcactttagggaggggtgtgtgtgtggtacacgcagatcgtgtgtatgtcatgtggataaaatctccccgttccctcgttcctttccttactccgcagaaagaaaagaaatccagcgaatctgtttacattcccgaaatgccaggataaattgggaggattgcgtgtcagtgctgagagttcgagacagttgttttgcaagaaaagtgttggggtggacttttccttttcgcgtcctctagctttgccaggagaagagacggtggcccccacctcccaggaagagttggacaagcctccctgcctggggagggcgggccgccagctctgtggtggacacatggccagacaggcccaccctgcgggacccacggagggaggcgcggcggcgggcgctgctaggagcagtggcttcgcacccagggcctctccacggccaggcttggagtgtggctgaggaccacggctcggagctcggagctggggctagactcacccccgcggctccggccgggcacgggaaggaggggcgaggcggggttttcatccaagaatgcgcatcggaacttttgctttttccttttttttcccccgtccttcttaaaagcaaaagctataatttataggtcttttcgattcgcagtgttctctatttgaactcgacattcaaactccgccaaagggggagggaggagcgggagttgggagtggggacggccgcggcggggaaggccgtgcgaggcggcggggcctgggacgcccctgcccggcggacttgaccgctctgcgctccgaggacgcagaatgcgcgcccctcttttgactcaaaagcacaaatcagtcccctccactccacccccgtctcttggagcacggatcccgcagcctccctgccctccccgcccttaaagggccagcgaagatctaacttcccattgcttgttgagggaggggcgcgggggccctgcacgccagaggaagcacagactcggggggagcgaggcggggagtcgggggtgggggagcttcgcgtggggtggggggtgctgggagggaaccccagcctcgtcctccgcactcccggcttctcagcctctcctccagactttcttgcctttaaagagagaaaaggagggaaacggtgtactacatgattgtgtttgtttttgaatatcaaattgcgcctataaagagaagcccctggaatggggatttttatctactcacatttgtaaaactggtattttagactttgtataaagaagcgccgttgaccgagtgtatctatttaaatgtcgatgctattttcagatgaaacttcactgaaggggcatgtctgttacctagtggacgggactgggggatacgcgtcttcacctggccgccgccttcccttctctcccgcctgtcctttactcccacctccctcccttcctgggggctgactttgccccttcccttggaccttctttccagccagctctgtccctgccgcccctccgtcctgctgtttgtccgtggccgtgtgtgtatgtgtctccttctctcgctcttgcgacgctgacctggggggtgggtgggcaggggccgggggccacgtggctgggagtctgcaaccgcgcagggtgtgtgcgctgttgggtttatttaattctaagatttgtacaaatctccaatcgatctccgcctcagctcaagagtgaagcttcggtacctatcttctgcggtcgtgaatgtctgtatccaataccgctttttacgtgtttaaatatatactttgtaaataga

SEQ ID NO: 117680 - DNA, 777 bp, Homo sapiens
  Payload ID: 2996
  Gene Symbol: CBX8
  Gene Name: chromobox homolog 8
  ENST ID: ENST00000413392
  CDS Start-End: 52-777
cactggacccggcgacgtcccccagcttcccgcgctggcgtttctcgcaggatgtccgccgcccacgttgggaagagcggtggacaggaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccga

SEQ ID NO: 117681 - DNA, 665 bp, Homo sapiens
  Payload ID: 2996
  Gene Symbol: CBX8
  Gene Name: chromobox homolog 8
  ENST ID: ENST00000427800
  CDS Start-End: 140-665
ggccttgggaccagtttccagaatgtcgggtcaccctgcggcattcccgcagcaggcggcaggcgcccagccctagctcggcgtctaggaagcagcgctgcgggacgcccgcccggctccgggaccgcgggagggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggcc

SEQ ID NO: 117682 - DNA, 6457 bp, Homo sapiens
  Payload ID: 2997
  Gene Symbol: CHD1
  Gene Name: chromodomain helicase DNA binding protein 1
  Uniprot ID: O14646
  ENST ID: ENST00000284049
  CDS Start-End: 149-5281
gtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaagga

SEQ ID NO: 117683 - DNA, 736 bp, Homo sapiens
  Payload ID: 2997
  Gene Symbol: CHD1
  Gene Name: chromodomain helicase DNA binding protein 1
  ENST ID: ENST00000505657
  CDS Start-End: 1-342
gaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaacaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaata

SEQ ID NO: 117684 - DNA, 848 bp, Homo sapiens
  Payload ID: 2997
  Gene Symbol: CHD1
  Gene Name: chromodomain helicase DNA binding protein 1
  ENST ID: ENST00000512844
  CDS Start-End: 1-69
atttctgaagaatctgaagagctggatcagaagacattcagcattaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacaga

SEQ ID NO: 117685 - DNA, 817 bp, Homo sapiens
  Payload ID: 2997
  Gene Symbol: CHD1
  Gene Name: chromodomain helicase DNA binding protein 1
  ENST ID: ENST00000511067
  CDS Start-End: 1-817
atcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaa

SEQ ID NO: 117686 - DNA, 8095 bp, Homo sapiens
  Payload ID: 2997
  Gene Symbol: CHD1
  Gene Name: chromodomain helicase DNA binding protein 1
  Uniprot ID: O14646
  ENST ID: ENST00000614616
  CDS Start-End: 568-5700
gggaggcggaggcgacggcgacctcggtggcggcggcggctacgacggagacggttgcgctcgcttgctttctcggcgtcatggcggctgccgggggcagataagcggagggagcgggagcgcgcgcgcgacggcggcggcggcggcggcgacgactggttacttatagctcttgctgccctcgcccttggtgcttcaataatgaattgttagctccactccgcaggggatcgcgcgttggtgctgcggaccggggcttccccttcccctccgcgtctgtccccttccccctcccccgcacggactcttgcttaccccgagacgccggagccctaggactgggcggcggagatcccgggcctgggcgcgggggaggccgtccacccgagtcggctccctccgccccgccaagcccgccggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagatttttattttgttttatattcagcgggaagtttttaagtcatgtggcacacattcttgcatgtatgctttgatgtaacaaatttgaatctttgacgaatataagtatgtggacataatttctatagtattgctatgtgtgtcactgttaattagctgtgggagcaacctacagatatttgtccataggtgtattttttaatattttcctttgtccaattaggtttatgtgtataaaagcttgtgggtttttttgctttttgttttgttttttgcagtaatttctctttctgatacagttaccctgaagaataataatgctttgtttcttttctggtatatgagagaacatgtgagggagtagctcagttttttaaacatctaatttataattaaatataaaagtaatgaaggtagtcctggcacacatttttgaaacttttatcacttttctctacatttagtatgactattttattccacaagatagcatttgactaattcataatgcttaagtcataagatggtggctggcattttttaatttattactaaaagctaagatatttgcattatattgtgcaaatttcacagaacaatgttgcattttctgagataaggctctaattttttaaatagtgctacatttagttgaaagtttcagtcagctagttagctgagttgaatgaaaaatatagaactgtatgtacatttatcaaatgataaaatatgttcatttttgtaagaaatcagaaaaattaagacgcaatggtgaagaacattagtacataaatatagcagaacattctccataaaatattctgttttcattctgctttgttatttttatccagttatgtttaatttttcaagggtgagagattatgtatagtactgtaccaattaaccttccacttttatacaataaataattcttactaaaa

SEQ ID NO: 117687 - DNA, 2484 bp, Homo sapiens
  Payload ID: 2998
  Gene Symbol: CHD1L
  Gene Name: chromodomain helicase DNA binding protein 1-like
  ENST ID: ENST00000361293
  CDS Start-End: 377-2227
gcgttgggaagttgggagggaggtgcgcgcttggccgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagattcccttggagtgttcttgttgtggatgaagctcacaggttgaaaaaccaaagctccctgctgcataagaccttgtcagagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaatggt

SEQ ID NO: 117688 - DNA, 2967 bp, Homo sapiens
  Payload ID: 2998
  Gene Symbol: CHD1L
  Gene Name: chromodomain helicase DNA binding protein 1-like
  Uniprot ID: Q86WJ1
  ENST ID: ENST00000369258
  CDS Start-End: 21-2714
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 117689 - DNA, 2358 bp, Homo sapiens
  Payload ID: 2998
  Gene Symbol: CHD1L
  Gene Name: chromodomain helicase DNA binding protein 1-like
  Uniprot ID: Q86WJ1
  ENST ID: ENST00000369259
  CDS Start-End: 21-2102
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaatgg

SEQ ID NO: 117690 - DNA, 2907 bp, Homo sapiens
  Payload ID: 2998
  Gene Symbol: CHD1L
  Gene Name: chromodomain helicase DNA binding protein 1-like
  ENST ID: ENST00000431239
  CDS Start-End: 257-2650
gcgttgggaagttgggagggaggtgcgcgcttggccgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaatggt

SEQ ID NO: 117691 - DNA, 2782 bp, Homo sapiens
  Payload ID: 2998
  Gene Symbol: CHD1L
  Gene Name: chromodomain helicase DNA binding protein 1-like
  ENST ID: ENST00000467213
  CDS Start-End: 21-1154
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 117692 - DNA, 2937 bp, Homo sapiens
  Payload ID: 2998
  Gene Symbol: CHD1L
  Gene Name: chromodomain helicase DNA binding protein 1-like
  ENST ID: ENST00000622533
  CDS Start-End: 21-269
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcaggcaatgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcct

SEQ ID NO: 117693 - DNA, 2415 bp, Homo sapiens
  Payload ID: 2998
  Gene Symbol: CHD1L
  Gene Name: chromodomain helicase DNA binding protein 1-like
  ENST ID: ENST00000488864
  CDS Start-End: 1-171
atggagcgcgcgggcgctactagccgcgggggccaagcccctggcttcttactgcggcttcatactgagggccgagccgaggcggcgcgggtgcaggagcaggacttacggcagtgggggctgacagattcccttggagtgttcttgttgtggatgaagctcacaggttgaaaaaccaaagctccctgctgcataagaccttgtcagagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcct

SEQ ID NO: 117694 - DNA, 9363 bp, Homo sapiens
  Payload ID: 2999
  Gene Symbol: CHD2
  Gene Name: chromodomain helicase DNA binding protein 2
  Uniprot ID: O14647
  ENST ID: ENST00000394196
  CDS Start-End: 577-6063
tctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaa

SEQ ID NO: 117695 - DNA, 2221 bp, Homo sapiens
  Payload ID: 2999
  Gene Symbol: CHD2
  Gene Name: chromodomain helicase DNA binding protein 2
  Uniprot ID: O14647
  ENST ID: ENST00000420239
  CDS Start-End: 562-2067
ggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaa

SEQ ID NO: 117696 - DNA, 649 bp, Homo sapiens
  Payload ID: 2999
  Gene Symbol: CHD2
  Gene Name: chromodomain helicase DNA binding protein 2
  ENST ID: ENST00000629104
  CDS Start-End: 1-108
ggggtggaagatgattctcgcctgttgctggggatttatgaacatggctatggaaactgggagttaattaaaacagacccagagcttaaattaactgacaaactttaacctagctccagggattccctgctcctggaaggaggaaatccacgacggctgggatgctctagcagatgaagccacaagcccctcctacctgagttgttctaccctgttaacagcacagattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagt

SEQ ID NO: 117697 - DNA, 888 bp, Homo sapiens
  Payload ID: 2999
  Gene Symbol: CHD2
  Gene Name: chromodomain helicase DNA binding protein 2
  ENST ID: ENST00000625990
  CDS Start-End: 716-888
ctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctc

SEQ ID NO: 117698 - DNA, 760 bp, Homo sapiens
  Payload ID: 2999
  Gene Symbol: CHD2
  Gene Name: chromodomain helicase DNA binding protein 2
  ENST ID: ENST00000627460
  CDS Start-End: 1-104
ggtctcaagaagaagaggagcaaaagaagaaagacgacgtgactggggaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaa

SEQ ID NO: 117699 - DNA, 5127 bp, Homo sapiens
  Payload ID: 2999
  Gene Symbol: CHD2
  Gene Name: chromodomain helicase DNA binding protein 2
  ENST ID: ENST00000625662
  CDS Start-End: 1-232
tgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaactccagggattccctgctcctggaaggaggaaatccacgacggctgggatgctctagcagatgaagccacaagcccctcctacctgagttgttctaccctgttaacagcacagattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaa

SEQ ID NO: 117700 - DNA, 340 bp, Homo sapiens
  Payload ID: 2999
  Gene Symbol: CHD2
  Gene Name: chromodomain helicase DNA binding protein 2
  ENST ID: ENST00000625463
  CDS Start-End: 1-340
ccccctgaagaaaatgaaagggaaaatggacaggagattcttctgcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatgg

SEQ ID NO: 117701 - DNA, 361 bp, Homo sapiens
  Payload ID: 2999
  Gene Symbol: CHD2
  Gene Name: chromodomain helicase DNA binding protein 2
  ENST ID: ENST00000625243
  CDS Start-End: 1-361
catcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctcatagtcggaagccggcaccctcaaatgagcccgaatatctatgtaaatggatgggactcccctattcagagtgtagctgggaagatgaagccctcattggaaagaaattccagaattgcattgacagc

SEQ ID NO: 117702 - DNA, 2131 bp, Homo sapiens
  Payload ID: 2999
  Gene Symbol: CHD2
  Gene Name: chromodomain helicase DNA binding protein 2
  ENST ID: ENST00000626782
  CDS Start-End: 436-1980
agggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagag

SEQ ID NO: 117703 - DNA, 7764 bp, Homo sapiens
  Payload ID: 2999
  Gene Symbol: CHD2
  Gene Name: chromodomain helicase DNA binding protein 2
  Uniprot ID: O14647
  ENST ID: ENST00000626874
  CDS Start-End: 708-5927
ccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttgtgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccgaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttgg

SEQ ID NO: 117704 - DNA, 1740 bp, Homo sapiens
  Payload ID: 2999
  Gene Symbol: CHD2
  Gene Name: chromodomain helicase DNA binding protein 2
  ENST ID: ENST00000627622
  CDS Start-End: 576-713
ctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaa

SEQ ID NO: 117705 - DNA, 607 bp, Homo sapiens
  Payload ID: 2999
  Gene Symbol: CHD2
  Gene Name: chromodomain helicase DNA binding protein 2
  ENST ID: ENST00000630016
  CDS Start-End: 1-214
tacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgag

SEQ ID NO: 117706 - DNA, 1249 bp, Homo sapiens
  Payload ID: 2999
  Gene Symbol: CHD2
  Gene Name: chromodomain helicase DNA binding protein 2
  ENST ID: ENST00000629346
  CDS Start-End: 573-668
agagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaa

SEQ ID NO: 117707 - DNA, 3202 bp, Homo sapiens
  Payload ID: 2999
  Gene Symbol: CHD2
  Gene Name: chromodomain helicase DNA binding protein 2
  ENST ID: ENST00000628375
  CDS Start-End: 573-1850
agagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttca

SEQ ID NO: 117708 - DNA, 7328 bp, Homo sapiens
  Payload ID: 3000
  Gene Symbol: CHD3
  Gene Name: chromodomain helicase DNA binding protein 3
  Uniprot ID: Q12873
  ENST ID: ENST00000330494
  CDS Start-End: 151-6153
atatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctgataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 117709 - DNA, 7286 bp, Homo sapiens
  Payload ID: 3000
  Gene Symbol: CHD3
  Gene Name: chromodomain helicase DNA binding protein 3
  Uniprot ID: Q12873
  ENST ID: ENST00000358181
  CDS Start-End: 211-6111
atctttgtttgggtctcccatactgcgtatagatgaatgggtcaggatatctggaacaaaatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctgataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 117710 - DNA, 7356 bp, Homo sapiens
  Payload ID: 3000
  Gene Symbol: CHD3
  Gene Name: chromodomain helicase DNA binding protein 3
  Uniprot ID: Q12873
  ENST ID: ENST00000380358
  CDS Start-End: 2-6181
gatggcttcccctctgagggacgaggaggaggaggaggaggagatggtggtgtcggaggaggaagaagaggaggaagaagagggcgacgaggaggaggaggaggaggtggaggcggccgacgaggacgatgaggaggacgacgacgagggagtactcgggcgcgggccgggccacgaccggggccgcgaccgccacagcccccccggctgccacctcttcccgccgccgccgccgccgccgccaccgctgcccccgccgccgccgcccccgccgccagataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 117711 - DNA, 1263 bp, Homo sapiens
  Payload ID: 3000
  Gene Symbol: CHD3
  Gene Name: chromodomain helicase DNA binding protein 3
  ENST ID: ENST00000439235
  CDS Start-End: 1-1152
aagagagcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaagggtaagggccgcggcggccccgcgcgggggagggcccacaacgctgcttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaa

SEQ ID NO: 117712 - DNA, 1573 bp, Homo sapiens
  Payload ID: 3000
  Gene Symbol: CHD3
  Gene Name: chromodomain helicase DNA binding protein 3
  ENST ID: ENST00000452447
  CDS Start-End: 1-1573
gcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagg

SEQ ID NO: 117713 - DNA, 880 bp, Homo sapiens
  Payload ID: 3000
  Gene Symbol: CHD3
  Gene Name: chromodomain helicase DNA binding protein 3
  ENST ID: ENST00000449744
  CDS Start-End: 1-834
ttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaagggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccc

SEQ ID NO: 117714 - DNA, 330 bp, Homo sapiens
  Payload ID: 3000
  Gene Symbol: CHD3
  Gene Name: chromodomain helicase DNA binding protein 3
  ENST ID: ENST00000571249
  CDS Start-End: 1-330
agagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtggccggggaggaggaggttgatggctacgagacggatcaccaggattactgtgaggtgtgccagcagggtg

SEQ ID NO: 117715 - DNA, 749 bp, Homo sapiens
  Payload ID: 3000
  Gene Symbol: CHD3
  Gene Name: chromodomain helicase DNA binding protein 3
  ENST ID: ENST00000573936
  CDS Start-End: 1-749
cgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggcct

SEQ ID NO: 117716 - DNA, 3744 bp, Homo sapiens
  Payload ID: 3000
  Gene Symbol: CHD3
  Gene Name: chromodomain helicase DNA binding protein 3
  ENST ID: ENST00000470531
  CDS Start-End: 1-192
agtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagactggacttcagagagaaacgtaggcacagacagtactggtaaacacagaagggtaccttctgagacagtgcaggagaaacactgtcagagggattagaggagagatttagaaaacatgaggagagcacattgcaggtaagagatggcatggaacatgcgcaatgtccagaaaatgtatgcagagccacgaagctgcaggagtggggagaccggattgggctgacgcagcagagtagggatttccttgcagtggaaggattagcaaagaaggagacccccagtgttcattcattctgttgcccttcagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 117717 - DNA, 6496 bp, Homo sapiens
  Payload ID: 3001
  Gene Symbol: CHD4
  Gene Name: chromodomain helicase DNA binding protein 4
  Uniprot ID: Q14839
  ENST ID: ENST00000357008
  CDS Start-End: 165-5903
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 117718 - DNA, 1317 bp, Homo sapiens
  Payload ID: 3001
  Gene Symbol: CHD4
  Gene Name: chromodomain helicase DNA binding protein 4
  ENST ID: ENST00000545942
  CDS Start-End: 256-1317
atgggctgtccgtgggggggcggggcctgtgcggtgggatttcccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaa

SEQ ID NO: 117719 - DNA, 6554 bp, Homo sapiens
  Payload ID: 3001
  Gene Symbol: CHD4
  Gene Name: chromodomain helicase DNA binding protein 4
  ENST ID: ENST00000544484
  CDS Start-End: 148-5961
cgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccccgctcatctgccctctctccctccagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 117720 - DNA, 6514 bp, Homo sapiens
  Payload ID: 3001
  Gene Symbol: CHD4
  Gene Name: chromodomain helicase DNA binding protein 4
  ENST ID: ENST00000544040
  CDS Start-End: 204-5921
gtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 117721 - DNA, 553 bp, Homo sapiens
  Payload ID: 3001
  Gene Symbol: CHD4
  Gene Name: chromodomain helicase DNA binding protein 4
  ENST ID: ENST00000545584
  CDS Start-End: 177-553
ttgcaccagcctgccctcggaggcgtcgctccctcgctccgtgggggcgcctgccggggagccggcttccgggctgcccccgaggagtgtggaactaatgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaa

SEQ ID NO: 117722 - DNA, 9646 bp, Homo sapiens
  Payload ID: 3002
  Gene Symbol: CHD5
  Gene Name: chromodomain helicase DNA binding protein 5
  Uniprot ID: Q8TDI0
  ENST ID: ENST00000262450
  CDS Start-End: 101-5965
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 117723 - DNA, 3044 bp, Homo sapiens
  Payload ID: 3002
  Gene Symbol: CHD5
  Gene Name: chromodomain helicase DNA binding protein 5
  ENST ID: ENST00000377999
  CDS Start-End: 1-333
atgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggtctgtgctgctgccgcccaccaccctcccagggggcctctcatcccgggcctcaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcg

SEQ ID NO: 117724 - DNA, 4966 bp, Homo sapiens
  Payload ID: 3002
  Gene Symbol: CHD5
  Gene Name: chromodomain helicase DNA binding protein 5
  ENST ID: ENST00000496404
  CDS Start-End: 1-3678
atgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatgg

SEQ ID NO: 117725 - DNA, 558 bp, Homo sapiens
  Payload ID: 3002
  Gene Symbol: CHD5
  Gene Name: chromodomain helicase DNA binding protein 5
  ENST ID: ENST00000475121
  CDS Start-End: 1-271
ccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaa

SEQ ID NO: 117726 - DNA, 4396 bp, Homo sapiens
  Payload ID: 3002
  Gene Symbol: CHD5
  Gene Name: chromodomain helicase DNA binding protein 5
  ENST ID: ENST00000462991
  CDS Start-End: 1-3181
ctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagcgtcttgctctgtcactcaggctggagtgcagtggcgccatctcggctcatgggagcctttatctcctcggctcaagcgaccctcccacctcagcttcctgaacagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaa

SEQ ID NO: 117727 - DNA, 646 bp, Homo sapiens
  Payload ID: 3002
  Gene Symbol: CHD5
  Gene Name: chromodomain helicase DNA binding protein 5
  ENST ID: ENST00000491020
  CDS Start-End: 1-382
cttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtgctgtccccgaagagctccttgtgggtctctcctggaggcctttccgtttcctcctctgctccccaccctccgtgcagacctggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtgg

SEQ ID NO: 117728 - DNA, 1635 bp, Homo sapiens
  Payload ID: 3003
  Gene Symbol: CHD6
  Gene Name: chromodomain helicase DNA binding protein 6
  ENST ID: ENST00000309279
  CDS Start-End: 111-1577
tggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaaggcaacacagataaagaagacaatgctgaggacaaagtagatggcctccagaaacaaacggtgagtcaaatg

SEQ ID NO: 117729 - DNA, 2477 bp, Homo sapiens
  Payload ID: 3003
  Gene Symbol: CHD6
  Gene Name: chromodomain helicase DNA binding protein 6
  Uniprot ID: Q8TD26
  ENST ID: ENST00000373222
  CDS Start-End: 40-1161
ctgtttgtattttggctgctgcaggagccattttagcccatgtgtcagtctcatatgattggcttttgtaccagttctgtaaatgaagaaactgagacccagggagatcaaataagttgcccaaatcccacaacgcttgtgttcagaacccagatatcttcactcccaagtctacagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttgtacgtctatttaaagtattctctgtatttgggttttatatgaataaaactttttttctcttgtgactttattatcttctacatcttcagagtcttgcctctaaggcatgacccacaggtcttggctgactcaagtttaccttaggcagtaacgctcaattatagctgcacacagaattacctggagagcttttttaaacctctaaagcctttgctccacccaagaccattggctcagactcagtggggcccaaggattgttgtgtttttaaaaactccttgggcaattctcatatgcaaccagggtagagaaccactctcctgtagcatatgctcttttcccctcttgtatattttcctttctgctacagacccactttcactaatgtgtgttaatgataacctgcccacagctgccctgcctctgttctcagccagtttctctagaagctgcagagagatcagttgcttggaattactccgttttgttttgttttctgttgttgcccttaaggggaaggtctttctaagcccaatctccagcagtttcacaataaaccattttactatttctgtgttaggtggtcaccgtgtttattgaacaccttaaagctcgatcatttgctagttatgtgcttgcctgacaatttgtatgtctttggatagttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacaca

SEQ ID NO: 117730 - DNA, 10818 bp, Homo sapiens
  Payload ID: 3003
  Gene Symbol: CHD6
  Gene Name: chromodomain helicase DNA binding protein 6
  Uniprot ID: Q8TD26
  ENST ID: ENST00000373233
  CDS Start-End: 179-8326
atgaccaatgggtctgtgttttggaccggcgaagcccaatggcgcgacagggaaggcgggcccgagatgggttagggtgtccttgcagggtgtctgagctaaacttcaccaaataatagctgtttgtattttggctgctgcaggagccattttagaaataaatatcttccttcaatagatgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttgaacccatcactgaggaacgtgctgcaagaactctgtaccgcattgaactgttacggaaagtccgagagcaagtgctcaagtgccctcagctgcatgaacgcctccagctgtgcaggcccagcctctacctcccagtctggtgggagtgtgggaagcatgatcgagacctgctcatcggcactgccaaacatgggctgaaccgcactgactgttacatcatgaacgacccccagctgtccttcctggatgcctatagaaactatgcccagcataaaagatctggcacccaggcaccaggaaatctctgttgcctttaccagaccaactccaagttatatgaatctcttacatattctcaaatgagtaggacttcagagtcccttgaaaatgaacctgaaaatctagtgagagtagaaagcagagatgatcatctcagcctgcctgatgtgacatgtgaaaactttatttctaaagttcaggatgtcatttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggaccgcgtgataattaaccgcctagataatatctgccacgtggtgttaaaggggaagtggccctctagccagcagtatgagccctcaggcacactgcccaccccggtattaaccagcagtgctggttctcgaaccagcctctcagagccggaagcagcagaacacagcttcagcaacggcgcagcattggcggcccagatccacaaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaaactgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagccaaatttaaactctcttcagcaaacttgagccttttcatctaattccatgtcactcacggccataactttccttgaccattcttcaccccatgtcttacataataaattgtggtcttgatcctggatttaaaaacaaaa

SEQ ID NO: 117731 - DNA, 536 bp, Homo sapiens
  Payload ID: 3003
  Gene Symbol: CHD6
  Gene Name: chromodomain helicase DNA binding protein 6
  ENST ID: ENST00000440647
  CDS Start-End: 89-536
gttcatgttgtggaggcgttgataccctcatgagaaattctgttacttccataaaagtcctgaagaaataaatatcttccttcaatagatgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatg

SEQ ID NO: 117732 - DNA, 1635 bp, Homo sapiens
  Payload ID: 3003
  Gene Symbol: CHD6
  Gene Name: chromodomain helicase DNA binding protein 6
  ENST ID: ENST00000440697
  CDS Start-End: 1-1577
tggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaaggcaacacagataaagaagacaatgctgaggacaaagtagatggcctccagaaacaaacggagagttccagt

SEQ ID NO: 117733 - DNA, 11568 bp, Homo sapiens
  Payload ID: 3004
  Gene Symbol: CHD7
  Gene Name: chromodomain helicase DNA binding protein 7
  Uniprot ID: Q9P2D1
  ENST ID: ENST00000423902
  CDS Start-End: 480-9473
cggcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttgtacagtttcttgatatatcctcttatactagattagcttttggtaagacactaaactgtctcgaagactagacaggaaggaaaaccttgaattactctcacataattccactccagatatctcaacagaaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagtgtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacacccttcccccaggacgtccgcacacagtccacctccagccagtgtgctgccagacaggtggtctaaattcctcccagactgtgagattcagttcgtttatgccccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaaa

SEQ ID NO: 117734 - DNA, 434 bp, Homo sapiens
  Payload ID: 3004
  Gene Symbol: CHD7
  Gene Name: chromodomain helicase DNA binding protein 7
  ENST ID: ENST00000527825
  CDS Start-End: 1-58
cagctccatgtggggccccagggctgttcaggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaa

SEQ ID NO: 117735 - DNA, 398 bp, Homo sapiens
  Payload ID: 3004
  Gene Symbol: CHD7
  Gene Name: chromodomain helicase DNA binding protein 7
  ENST ID: ENST00000527900
  CDS Start-End: 1-120
caccagccttgggcacagctccacccatcaccccagaacaccccgcagaaagtgcctgtgcatcagcattccccgtcggagccctttctagagaaaccagtgccggatatgactcagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcagg

SEQ ID NO: 117736 - DNA, 4777 bp, Homo sapiens
  Payload ID: 3004
  Gene Symbol: CHD7
  Gene Name: chromodomain helicase DNA binding protein 7
  Uniprot ID: Q9P2D1
  ENST ID: ENST00000525508
  CDS Start-End: 1-3417
atggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaaacaaaatctagttttgcttaaaggaaaaagtctgactgaattatcctatttagggtgggatttcccatttttcttcctaatgaattattattaaagcgatcctaagatctgtctcaaa

SEQ ID NO: 117737 - DNA, 500 bp, Homo sapiens
  Payload ID: 3004
  Gene Symbol: CHD7
  Gene Name: chromodomain helicase DNA binding protein 7
  ENST ID: ENST00000526846
  CDS Start-End: 403-500
ttgggctccaactcaagtgcgagcgggcgatgggcgcgcgggcgcggggcggctgagcagcggcggcggcggctcggggacggcggcgacccccgcctcccgcccccgccccccgctccggaccgaccacgccgcgctcgccgggagctgcggccgcaccggcgcgaacaaagtgcgttcctcccggcgcggcggcgccagcccgcgcggggaccgccaccgagcgaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatcc

SEQ ID NO: 117738 - DNA, 3456 bp, Homo sapiens
  Payload ID: 3004
  Gene Symbol: CHD7
  Gene Name: chromodomain helicase DNA binding protein 7
  Uniprot ID: Q9P2D1
  ENST ID: ENST00000524602
  CDS Start-End: 69-2915
acctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaa

SEQ ID NO: 117739 - DNA, 8229 bp, Homo sapiens
  Payload ID: 3005
  Gene Symbol: CHD8
  Gene Name: chromodomain helicase DNA binding protein 8
  Uniprot ID: Q9HCK8
  ENST ID: ENST00000399982
  CDS Start-End: 66-7811
gccagtaccccccctccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcacaaattcaggcccaaggtatcaccagcacagctcagcccctggtggcaggcacagccaatggtggaaaagtcacttttaccaaagtgctaaccggcacaccccttcgaccaggtgtttccattgtctctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttttcc

SEQ ID NO: 117740 - DNA, 7420 bp, Homo sapiens
  Payload ID: 3005
  Gene Symbol: CHD8
  Gene Name: chromodomain helicase DNA binding protein 8
  Uniprot ID: Q9HCK8
  ENST ID: ENST00000430710
  CDS Start-End: 93-7001
tgctggagagacagggagaggggcgaaccggccccccacagccactgcaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttttcca

SEQ ID NO: 117741 - DNA, 543 bp, Homo sapiens
  Payload ID: 3005
  Gene Symbol: CHD8
  Gene Name: chromodomain helicase DNA binding protein 8
  ENST ID: ENST00000553283
  CDS Start-End: 249-543
gtgctggagagacagggagaggggcgaaccggccccccacagccactgcaggtaaagccacctctctcctccactggggtgaggcacagctcgttttctccttcagggcttgtcgggcctctcggcctgcagcttccgccctaacattgctcctatcccgggcatccacaccccccaccccccgcatcttcccgtcttggccatccccaccctggagggcacccccgctagctccttacctcaagtgcatgtacctcatttccattttggggtctccagttaccagaaatcttccgcctctgctgtatggaccttactggcaccaaccccggcagtatgagcagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccac

SEQ ID NO: 117742 - DNA, 633 bp, Homo sapiens
  Payload ID: 3005
  Gene Symbol: CHD8
  Gene Name: chromodomain helicase DNA binding protein 8
  ENST ID: ENST00000553622
  CDS Start-End: 180-633
gcgcaggaggagggggaactggtgctggagagacagggagaggggcgaaccggccccccacagccactgcagttaccagaaatcttccgcctctgctgtatggaccttactggcaccaaccccggcagtatgagcaggagttccaccatcttcctctgaagacgtagccatcttgctccatgaaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcac

SEQ ID NO: 117743 - DNA, 679 bp, Homo sapiens
  Payload ID: 3005
  Gene Symbol: CHD8
  Gene Name: chromodomain helicase DNA binding protein 8
  ENST ID: ENST00000553870
  CDS Start-End: 1-679
attgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacaca

SEQ ID NO: 117744 - DNA, 2617 bp, Homo sapiens
  Payload ID: 3005
  Gene Symbol: CHD8
  Gene Name: chromodomain helicase DNA binding protein 8
  ENST ID: ENST00000555935
  CDS Start-End: 1-2617
taaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcagtctttgatgtctcccctttcccaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaa

SEQ ID NO: 117745 - DNA, 8137 bp, Homo sapiens
  Payload ID: 3005
  Gene Symbol: CHD8
  Gene Name: chromodomain helicase DNA binding protein 8
  Uniprot ID: Q9HCK8
  ENST ID: ENST00000557364
  CDS Start-End: 265-8010
agggtgagttgaaacgctgcctggaaaggaagtaccaggacttgcacaggagttccaccatcttcctctgaagacgtagccatcttgctccatgaaggtcaggacaatctgacatgcacttgtttcttgcctctatacttgaagagtagtcctcttacattgtgtacatttttttcttaataggggaggggaggggagagccagtaccccccctccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcacaaattcaggcccaaggtatcaccagcacagctcagcccctggtggcaggcacagccaatggtggaaaagtcacttttaccaaagtgctaaccggcacaccccttcgaccaggtgtttccattgtctctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaagg

SEQ ID NO: 117746 - DNA, 11337 bp, Homo sapiens
  Payload ID: 3006
  Gene Symbol: CHD9
  Gene Name: chromodomain helicase DNA binding protein 9
  Uniprot ID: Q3L8U1
  ENST ID: ENST00000398510
  CDS Start-End: 88-8781
cggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagc

SEQ ID NO: 117747 - DNA, 11509 bp, Homo sapiens
  Payload ID: 3006
  Gene Symbol: CHD9
  Gene Name: chromodomain helicase DNA binding protein 9
  Uniprot ID: Q3L8U1
  ENST ID: ENST00000447540
  CDS Start-End: 210-8903
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatg

SEQ ID NO: 117748 - DNA, 11504 bp, Homo sapiens
  Payload ID: 3006
  Gene Symbol: CHD9
  Gene Name: chromodomain helicase DNA binding protein 9
  Uniprot ID: Q3L8U1
  ENST ID: ENST00000564845
  CDS Start-End: 303-8948
gctggtggggtcgcgctgggggagtgaactgggccaatcaggcgggtgcgtggcggcgcgggggaggcggtgccccttcactcctccctccactccctccctgccccgcgctgacaggggggcctggccgcgcagccggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagc

SEQ ID NO: 117749 - DNA, 703 bp, Homo sapiens
  Payload ID: 3006
  Gene Symbol: CHD9
  Gene Name: chromodomain helicase DNA binding protein 9
  ENST ID: ENST00000565442
  CDS Start-End: 329-703
gtactgcatcgccatcttgagcttgttgctgtttcctcgagtcttggttatttgttatagcctgtaggccttaaggtggcattttagtgagcaattctaaaccctccttcctttcccagtgctgcagtgctgctatgaaacctttgatgaggcaggtatagaaaaaatatccagtgaagcacactggaatcagcatgaaaatgtgtttggaaattcctgatggttttttcctttggtatagtcagaggcatgtttacggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaa

SEQ ID NO: 117750 - DNA, 2169 bp, Homo sapiens
  Payload ID: 3006
  Gene Symbol: CHD9
  Gene Name: chromodomain helicase DNA binding protein 9
  ENST ID: ENST00000565832
  CDS Start-End: 274-2169
agccagaggaagtgaggctcagacagagcagctgctgttccagcaacagcagcaactgccgcacccttgaaaggaggcccctgccgtgtggacccgtaaaataaaatgggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaa

SEQ ID NO: 117751 - DNA, 3625 bp, Homo sapiens
  Payload ID: 3006
  Gene Symbol: CHD9
  Gene Name: chromodomain helicase DNA binding protein 9
  ENST ID: ENST00000565803
  CDS Start-End: 330-3625
attcatgctgatgcattttgatgctttgtgcattcatttctttctgtgctttgttggaatctggctatctgcttacagctattgaggaaactcagctttttaggagtgtttacagcctttttcatacctaaataggatgaacagtagatataaacttgccaaggcagaaatgtgttgataaatcaaaatgtgtatttgtggagggttgtgcatctcttggttgcagcttgctaaataggccatttaggaatcttctttcaatgcttttttcttgagcactgcctggggtggtgaaaaagcagagggcaagcctttgtctgacgccaaaaatgtcttcagtgaagaggccaagaggaaggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctagg

SEQ ID NO: 117752 - DNA, 13110 bp, Homo sapiens
  Payload ID: 3006
  Gene Symbol: CHD9
  Gene Name: chromodomain helicase DNA binding protein 9
  Uniprot ID: Q3L8U1
  ENST ID: ENST00000566029
  CDS Start-End: 210-8855
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatgatgtcagcctctgtacatgagaatactttttaaaattgaattttatatagaatttatcttattccagttatgagagacaccatagttgtaaatctttaaaaggaaaatataccgtggaagaatttttaaaacaaaaattggctataattttatccacagtatcttaaatgctgtcaatttttcattttgatttaattttattaatattgttcattgtggatattggtgactgcaaaaaaagcaaaagctgcttcttgggcattcaaattgttaaaccccaattttgcagcccaatctcaacttcatgctgaacattaagtattattttcttaagtttttggacttttaaaaaactcagaaatactcagagatattcctcacctctttaagaagtccattttggaaatcaataattatttttttcccttagtcttaagagtgtttcctaactcattgccatgggtagtgttcttcgtaaacattgaagaaaatagtttttcctctaattacacaactaaaacagtggagtctcatactcatttaacttgaacacattcaactacactttcatgtttagaaaacctttttttcatttttgtacaacataacatataaacacaaaccaactgcttcatctagtactcacccagaggaacagtagtctgttccagtgttggaggaagaattgcctatgttggacatttttgagaagagatatgaggtataaaatgatgtattctgtaatttgtgagctctgtgagagaaaagagtgattttttttttttttataaagacaaggtcttgctctgcctcccctagggtggagtgcagtggtgcgatcacagcccactgcatccttgacctgttgggctcaagcaatcctccctcctcagcctcctgagtagctgagactacagcatgcatcaccacaacgagctaatttttgtattttttgtagagatggggttttgccgtgttgcccaggctgatctcaaactcctgggctcaagcagtctacccatctcggcctcccaaagtgctgggattacaggtgtgagccaccacacccagccagaaatgatttttgactacacctaatattcactttatacaataaacttagaacttaatctctatataagctatttattttaaaattcagaaaagcaaaaaaatatttaaatcattcataaactaaaactacccagagataaacactgtcagtaatatattcaatcttttgtatatctatgttatttacatgtagtgggttgagtagtgtcattcagaaactgatgtcaacctaaaacctcagaatgtggccttattttggaaatcgggtcttggcaaatgtaattagttgtagtcatgccggattagggtgggccctaaatccaatgactagtgtccttagaagaagagcagaagatactcagaaacactgggaaggctgttttgtgataaaggagaccggagggatgttcctacaactagggaacaccaaggattgccagcaaccaccagaagctaggagagaagtaacaagcattctccttcatagcttccggaaagaaccaaccttgccaacaccttgatttggggtttctaacctgaactgtaagagaataaatttccattgttttaagtca

SEQ ID NO: 117753 - DNA, 488 bp, Homo sapiens
  Payload ID: 3006
  Gene Symbol: CHD9
  Gene Name: chromodomain helicase DNA binding protein 9
  ENST ID: ENST00000563410
  CDS Start-End: 330-488
gcggccgctgctcaactggtggggagatgcgggggcgggtcgtgtcagacgggtggtcgcctgaggccgcccccgcccggccagccgcgagtgtcagtctcagtcgaggcggggggcggcgggggcgcctcagtcatggcgaagcgcgagagtcagcgagcggcggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactg

SEQ ID NO: 117754 - DNA, 359 bp, Homo sapiens
  Payload ID: 3006
  Gene Symbol: CHD9
  Gene Name: chromodomain helicase DNA binding protein 9
  ENST ID: ENST00000562785
  CDS Start-End: 85-359
aaatgatccaataatatctactatagagaagctgaatatactccatttggagtgaacagcccggattgttacagaattttcaagatgacagatccaatgatggacttttttgatgatgccaatctttttggtgagaccttagaagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaag

SEQ ID NO: 117755 - DNA, 589 bp, Homo sapiens
  Payload ID: 3006
  Gene Symbol: CHD9
  Gene Name: chromodomain helicase DNA binding protein 9
  ENST ID: ENST00000564641
  CDS Start-End: 1-340
tccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaagatcagaaaattgaggctgaaagagatttactgatttgctcgagttcacatagctggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgc

SEQ ID NO: 117756 - DNA, 539 bp, Homo sapiens
  Payload ID: 3006
  Gene Symbol: CHD9
  Gene Name: chromodomain helicase DNA binding protein 9
  ENST ID: ENST00000564600
  CDS Start-End: 1-368
cacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggcttaaggattgatgagttattaaggaaaagaatctacctgctaaatccccataaacccccaagagggcctccattttcaatagaagcttaatgaaggagataataaaaaagagaagacaacagaattacagagactaagttggaggtgcatttgctccccctttgaaagatttatg

SEQ ID NO: 117757 - DNA, 10603 bp, Homo sapiens
  Payload ID: 3006
  Gene Symbol: CHD9
  Gene Name: chromodomain helicase DNA binding protein 9
  ENST ID: ENST00000615216
  CDS Start-End: 5106-7997
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatg

SEQ ID NO: 117758 - DNA, 3557 bp, Homo sapiens
  Payload ID: 3006
  Gene Symbol: CHD9
  Gene Name: chromodomain helicase DNA binding protein 9
  ENST ID: ENST00000622617
  CDS Start-End: 666-3557
caaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactga

SEQ ID NO: 117759 - DNA, 3419 bp, Homo sapiens
  Payload ID: 3007
  Gene Symbol: CDYL
  Gene Name: chromodomain protein, Y-like
  Uniprot ID: Q9Y232
  ENST ID: ENST00000328908
  CDS Start-End: 132-1928
ggagagaggacctatttctacctaaggacattcccggaaggcaatgggtttcaaacaatatcctgaagagactcatctcggggaactaagcaggtggtcatcagagaacacagagcccccggaagaattttatgacatttcaggcaagccacaggtcagcctggggaaaaagcaggaagaaaaactggcaatacgagggcccaacccaaaagttattcctgaagagaaacaacgtgtcagcaccagatgggccttcagaccccagcatctccgtgagcagtgagcaaagcggggcacagcagcctcccgctttacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacattt

SEQ ID NO: 117760 - DNA, 3241 bp, Homo sapiens
  Payload ID: 3007
  Gene Symbol: CDYL
  Gene Name: chromodomain protein, Y-like
  Uniprot ID: Q9Y232
  ENST ID: ENST00000343762
  CDS Start-End: 508-1746
ggttaaggagggaggggaaacaaaagcagtgtgctccaccaggctcctgcctcggctctaaggaaacagaggaaagcaaacgggaatactctggtttagtatactgcccgcttctggagtggacattgatttaaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaa

SEQ ID NO: 117761 - DNA, 2184 bp, Homo sapiens
  Payload ID: 3007
  Gene Symbol: CDYL
  Gene Name: chromodomain protein, Y-like
  Uniprot ID: Q9Y232
  ENST ID: ENST00000397588
  CDS Start-End: 350-1984
cggagaggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagct

SEQ ID NO: 117762 - DNA, 2139 bp, Homo sapiens
  Payload ID: 3007
  Gene Symbol: CDYL
  Gene Name: chromodomain protein, Y-like
  Uniprot ID: Q9Y232
  ENST ID: ENST00000449732
  CDS Start-End: 584-1822
actgtctggcactccctagtgagatgaacctggtacctcagatggaaatgctgaaatcacctgtcttctgcgtcgctcacgctgggagctgtagaccggagctgttcctattcggccatcttggctcctccccaaggcttaggtttctaagtcagccacaaatgctacccaaaactacataaagaagaaaaaagttgcatagaaccaaaaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtat

SEQ ID NO: 117763 - DNA, 690 bp, Homo sapiens
  Payload ID: 3007
  Gene Symbol: CDYL
  Gene Name: chromodomain protein, Y-like
  ENST ID: ENST00000440139
  CDS Start-End: 178-690
agacatgcctggtttggctggtgattgggaaaagaggaggatctcagatttcaggttttagttatcattctcccgagatgggaagaggctgtgattcttgatctgaagagtcttatcgtcggtagaacttgccatcgatgatcaattgtttggatttgaggaggagagaattgaattatgttggcctacaacaacgggagcaggtcaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtc

SEQ ID NO: 117764 - DNA, 2086 bp, Homo sapiens
  Payload ID: 3008
  Gene Symbol: CDYL2
  Gene Name: chromodomain protein, Y-like 2
  ENST ID: ENST00000562812
  CDS Start-End: 91-1614
cacacgcgcacaccggaccccgcgcgcacacgcacggagggcgcgagcgagcagacgcgcacaccggcgagccaagttccgcagcctggcatggcttctggggacctttacgaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggtggctctgctctgaccaacgggggattgaacctgcacagtccagtgaagaggaagctggaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctggccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgat

SEQ ID NO: 117765 - DNA, 2086 bp, Homo sapiens; identical to SEQ ID NO: 117764
  Payload ID: 3008
  Gene Symbol: CDYL2
  Gene Name: chromodomain protein, Y-like 2
  ENST ID: ENST00000563890
  CDS Start-End: 91-1614

SEQ ID NO: 117766 - DNA, 2086 bp, Homo sapiens; identical to SEQ ID NO: 117764
  Payload ID: 3008
  Gene Symbol: CDYL2
  Gene Name: chromodomain protein, Y-like 2
  ENST ID: ENST00000566173
  CDS Start-End: 91-1614

SEQ ID NO: 117767 - DNA, 8159 bp, Homo sapiens
  Payload ID: 3008
  Gene Symbol: CDYL2
  Gene Name: chromodomain protein, Y-like 2
  Uniprot ID: Q8N8U2
  ENST ID: ENST00000570137
  CDS Start-End: 157-1677
ctgtcattctgcaaaaacacagtttactcaacacaccacacacactcgcacacacacgcgcgcacacacacgcgcacaccggaccccgcgcgcacacgcacggagggcgcgagcgagcagacgcgcacaccggcgagccaagttccgcagcctggcatggcttctggggacctttacgaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggctctgctctgaccaacgggggattgaacctgcacagtccagtgaagaggaagctggaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctggccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgattgtgcacacctggcctcagtctcctttccgacgcaaatctgtgtgactattagggcttggtcttaaaacccaattgagtgatttgcaaacccagatattgtacatttagaaatgttttgttaaatatatatttttaaaacaatgtaagtggaaattctgataatttatgtgtattatatgtaaagctagttttgcaaaaacaaactactagggaaatgttttttctttccttggacttgttttatttatttatttttgtttatatattgtgatgtctgttgttcacacagatactattttcatactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggtttgtccttaggagacatcttgggagagttttttcttccctctgctgtctttaaggagttaaagggccctcttagcctgaatgatcctgaaacagacccagtcccaaattgcgtgatgttgggcaggagtggggataggccctacctgagaatagcatactgtctagaataagacttctttctttggggcaaatgactgaacttggatcctgcagtctgttgcttccatgtgatcagtgatttctggtattggccagggggatggggaagagttcccactctgctgagctgtctggaggtctgaatcttttccctccagaagctgaaatgactcatctgttttctagtttttttatgtacatagggagcaatgaccaggaatgagatctccttgcccctgtgcccctgggctgcaaggggactccagcagctgtgttagaccatcagattcaagtccctggattaactacagagaaggagggattgggggttgtggttttgagtggtgaggagaaagttcaggaaaacctgaagttgagagcagacaaatggaagggatgtgttctgcgtgaggtttaaaccatgggtcaagcacccagaaaaagctagattctcagattctcaggatggagggatttttttccgtttctatcacagcccctgcgtattcctggaggcccttggccctccccttcttcccctttcctgttgggcaccagcctttcttggcccttctttgaagagagtggaataaggcagcaagaagtgggcacagcttatggaggtgaggcaggcttagaagagagagttctggtgacagttctctaactctctgtggtcctttatcttttcctggcaatcaggtgcactgggcagggcaggtggaatgtattcgtggccctgagctttgagtttcaaagaacacgttgatagtctacaccagatctagagacatggtcctttaagcagtgaccctcaagttaatctggactgctggtccttctgatgaccttggttccctccctggaaagcgtgtctcctttaagagttcatgagggtcaggaaggaggggaaacctctccttcagccagaggaggatggaattaaagtcctgtgcaccctcccctttgtccatgtaggatcctgtaaggacttcggacctgtcctacagggagttactatagggagacacctgcttttgcccaaatgcctgttgtcacagctctatctggatcttatctcctcctttgagaaagcaaatgtgagctttccaaaacccttagatgaccctggttcttacatattgtggcagacagtgtcttcactactgctaaattttcattagaaagagccccctcttttctgttgaacttctgattgggcgcagttatattcagcatcggttgaagtggggtcaggattctccttggacatggaaggggatgtttagaaattcctttagatcagtgtccaccttcattccctgcttgaaagaactagaaatgcttcagctttggatgtactatcaaatccaaacttctaaacatttcaaggatctctgaagattaaggtaggaatgtgaaaccatttctaaggtggaaatcttgctgttaagtcacaggtcctgggtgtaacgggggtggtgaaagtctgtattttggttgtttccatacagtcagttccaccaattgggtgaaagcaggtgaaatctttttgctgcagggtggactgaatttttcactttctgggtagttgttttgatcatgtgtaggcgaattccaggtaacttacagcaaatagatttgggatggaaaataccagacctctggttgtgtcagggtttatcctaatagctttcctgagacagagctcagactttcatttttgatcttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctttagtcagggacctttctagcaatccactccctcccatcctgttagccatgcagtggaactctccttccctctctgccccaaccccggtgatggctcactctcagcatcttatgggaccatctgagttaacaaccctgttccaagaagactttgtgcagaacttttgttagggtggtcataccttctcaccaccatttggaagacacagcctaatgctgatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgtagatatttaagggaaaccatttggggttgtcttgcatgtatatttttgttgtagataagtgttgcttagttatttctgcaaattttggttgaaatgcttacagactttaatacagtatatattttcaaaatataaacttttatatttctgtgataagttaggatatgcgttttaggcaatatttttcattaatatcacttgttcttttgaaaaatagcatactggtttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcagtctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaacttc

SEQ ID NO: 117768 - DNA, 2321 bp, Homo sapiens
  Payload ID: 3009
  Gene Symbol: CDY1
  Gene Name: chromodomain protein, Y-linked, 1
  Uniprot ID: Q9Y6F8
  ENST ID: ENST00000306609
  CDS Start-End: 282-1946
ctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaaaatacctctgttgggatataaagcagccttccctcccagaaagacacagaatgatcagagatggtgcccttgactttatagtggcacaaacgcttcagagacacacaattataagagacttatcttttagcataaatacttatggctcaaaatccactgacgatcattctcctaaactgaacacatgactagaattggtggtgagatatcgcttgattttcttttcctttataaatgtctagttcttacccagttaacaaaagaaaactttatcgctctaaagtaaaacttgttacaccacattagtgaattatggaatgattttggtggaaatatccaggttctaatgtgtggaatgtgcagatttaggttactttagtgtatgttctagttaataagttaaaattctggacacattattaaaggcagaaacttctttcaaagcaaa

SEQ ID NO: 117769 - DNA, 2177 bp, Homo sapiens
  Payload ID: 3009
  Gene Symbol: CDY1
  Gene Name: chromodomain protein, Y-linked, 1
  Uniprot ID: Q9Y6F8
  ENST ID: ENST00000361963
  CDS Start-End: 282-1904
ctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaattgtcagtctgtctgctcaggacacaagaactaaggggcaacaaatgcatcatgagttgcaagatgccctaatccatcttcatagcccaaaacaatttcacccatagctaaggcttggaaacagaactggaaatgtccaagctatgtatttaaattatcacatcatttttaagcactgtagctttacaaggagtaacaaaacagcctctttgcccaaatgtgattattttatgcacacctaagcccaaatataaaaacagactcttcttgcaa

SEQ ID NO: 117770 - DNA, 2321 bp, Homo sapiens; identical to SEQ ID NO: 117768
  Payload ID: 3010
  Gene Symbol: CDY1B
  Gene Name: chromodomain protein, Y-linked, 1B
  Uniprot ID: Q9Y6F8
  ENST ID: ENST00000306882
  CDS Start-End: 282-1946

SEQ ID NO: 117771 - DNA, 2227 bp, Homo sapiens
  Payload ID: 3010
  Gene Symbol: CDY1B
  Gene Name: chromodomain protein, Y-linked, 1B
  Uniprot ID: Q9Y6F8
  ENST ID: ENST00000382407
  CDS Start-End: 332-1954
agagtaacaggcaggaagaaagctttctgtactacaccagagggttggggctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaattgtcagtctgtctgctcaggacacaagaactaaggggcaacaaatgcatcatgagttgcaagatgccctaatccatcttcatagcccaaaacaatttcacccatagctaaggcttggaaacagaactggaaatgtccaagctatgtatttaaattatcacatcatttttaagcactgtagctttacaaggagtaacaaaacagcctctttgcccaaatgtgattattttatgcacacctaagcccaaatataaaaacagactcttcttgcaa

SEQ ID NO: 117772 - DNA, 1954 bp, Homo sapiens
  Payload ID: 3011
  Gene Symbol: CDY2A
  Gene Name: chromodomain protein, Y-linked, 2A
  Uniprot ID: Q9Y6F7
  ENST ID: ENST00000250838
  CDS Start-End: 329-1954
gtaacaggcaggaagaaagctttctgtactacaccagagggttggggctgtggatttagctactctcacctgaggctactgagcaagctgtcatgcaccatgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaa

SEQ ID NO: 117773 - DNA, 2369 bp, Homo sapiens
  Payload ID: 3011
  Gene Symbol: CDY2A
  Gene Name: chromodomain protein, Y-linked, 2A
  ENST ID: ENST00000426790
  CDS Start-End: 327-1994
aacaggcaggaagaaagctttctgtactacaccagagggttggggctgtggatttagctactctcacctgaggctactgagcaagctgtcatgcaccatgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaaaatacctctattgggatataaagcagccttccctcccagaaagacacagaacgatcagagatggtgcccttgactttatagtggcacaaacacttcagagacacacaattataagagacttatcttttagcataaatacttatggcacaaaatccactgacgatcattctcctaaactgaacacatgactagaattggtggtgagatatcgcttgattttcttttcctttataaatgtctagttcttacccagttaacaaaagaaaactttatcgctctaaagtaaaacttgttacaccacattagtgaattatggaatcattttggtggaaatatccaggttctaatgtgtggaatgtgcagatttaggttactttagtgtatgttctagttaataagttaaaattctggacacattattaaaggcagaaacttctttcaaaacaaa

SEQ ID NO: 117774 - DNA, 1954 bp, Homo sapiens
  Payload ID: 3012
  Gene Symbol: CDY2B
  Gene Name: chromodomain protein, Y-linked, 2B
  Uniprot ID: Q9Y6F7
  ENST ID: ENST00000382867
  CDS Start-End: 329-1954
gtaacaggcaggaagaaagctttctgtactacaccagagggttggggctgtggatttagctactctcacctgaggctactgagcaagctgtcatgcaccacgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaa

SEQ ID NO: 117775 - DNA, 2369 bp, Homo sapiens
  Payload ID: 3012
  Gene Symbol: CDY2B
  Gene Name: chromodomain protein, Y-linked, 2B
  ENST ID: ENST00000544303
  CDS Start-End: 327-1994
aacaggcaggaagaaagctttctgtactacaccagagggttggggctgtggatttagctactctcacctgaggctactgagcaagctgtcatgcaccacgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaaaatacctctattgggatataaagcagccttccctcccagaaagacacagaacgatcagagatggtgcccttgactttatagtggcacaaacacttcagagacacacaattataagagacttatcttttagcataaatacttatggcacaaaatccactgacgatcattctcctaaactgaacacatgactagaattggtggtgagatatcgcttgattttcttttcctttataaatgtctagttcttacccagttaacaaaagaaaactttatcgctctaaagtaaaacttgttacaccacattagtgaattatggaatcattttggtggaaatatccaggttctaatgtgtggaatgtgcagatttaggttactttagtgtatgttctagttaataagttaaaattctggacacattattaaaggcagaaacttctttcaaaacaaa

SEQ ID NO: 117776 - DNA, 2063 bp, Homo sapiens
  Payload ID: 3013
  Gene Symbol: CHGA
  Gene Name: chromogranin A
  Uniprot ID: P10645
  ENST ID: ENST00000216492
  CDS Start-End: 281-1654
aagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggatgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctgaa

SEQ ID NO: 117777 - DNA, 1474 bp, Homo sapiens
  Payload ID: 3013
  Gene Symbol: CHGA
  Gene Name: chromogranin A
  ENST ID: ENST00000334654
  CDS Start-End: 185-1105
cgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaaggtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggatgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttat

SEQ ID NO: 117778 - DNA, 896 bp, Homo sapiens
  Payload ID: 3013
  Gene Symbol: CHGA
  Gene Name: chromogranin A
  ENST ID: ENST00000556076
  CDS Start-End: 204-320
ctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctaca

SEQ ID NO: 117779 - DNA, 2063 bp, Homo sapiens; identical to SEQ ID NO: 117776
  Payload ID: 3013
  Gene Symbol: CHGA
  Gene Name: chromogranin A
  Uniprot ID: P10645
  ENST ID: ENST00000613166
  CDS Start-End: 281-1654

SEQ ID NO: 117780 - DNA, 896 bp, Homo sapiens; identical to SEQ ID NO: 117778
  Payload ID: 3013
  Gene Symbol: CHGA
  Gene Name: chromogranin A
  ENST ID: ENST00000627311
  CDS Start-End: 204-320

SEQ ID NO: 117781 - DNA, 1474 bp, Homo sapiens; identical to SEQ ID NO: 117777
  Payload ID: 3013
  Gene Symbol: CHGA
  Gene Name: chromogranin A
  ENST ID: ENST00000630996
  CDS Start-End: 185-1105

SEQ ID NO: 117782 - DNA, 2550 bp, Homo sapiens
  Payload ID: 3014
  Gene Symbol: CHGB
  Gene Name: chromogranin B
  Uniprot ID: P05060
  ENST ID: ENST00000378961
  CDS Start-End: 205-2238
ccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 117783 - DNA, 1129 bp, Homo sapiens
  Payload ID: 3014
  Gene Symbol: CHGB
  Gene Name: chromogranin B
  ENST ID: ENST00000455042
  CDS Start-End: 261-1129
cacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggtcatttatttgcagaagatattacagatttccagcggaaagagaaagtgctgaaatgggtgtgttctcaagtagccatttggaggatgaaagaacactgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggagga

SEQ ID NO: 117784 - DNA, 579 bp, Homo sapiens
  Payload ID: 3015
  Gene Symbol: C1orf100
  Gene Name: chromosome 1 open reading frame 100
  Uniprot ID: Q5SVJ3
  ENST ID: ENST00000308105
  CDS Start-End: 114-557
actctgcagttgatccagcagcaggaggcagctgtacccatcactgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagaccgctcatagacttgacaattccacccaagacaaaatatcactatcagcctcaattagaccaacaaacactcattcgatatatttgtcttcgaagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaataa

SEQ ID NO: 117785 - DNA, 483 bp, Homo sapiens
  Payload ID: 3015
  Gene Symbol: C1orf100
  Gene Name: chromosome 1 open reading frame 100
  Uniprot ID: Q5SVJ3
  ENST ID: ENST00000366537
  CDS Start-End: 114-461
actctgcagttgatccagcagcaggaggcagctgtacccatcactgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaataa

SEQ ID NO: 117786 - DNA, 3038 bp, Homo sapiens
  Payload ID: 3016
  Gene Symbol: C1orf101
  Gene Name: chromosome 1 open reading frame 101
  Uniprot ID: Q5SY80
  ENST ID: ENST00000366531
  CDS Start-End: 361-2763
aatgcgcgaggcctggacgggagtggccgaggcggttgggcggaggcggagcaggcgccatgtcagcccgggaagtggccgtgctgctgctgtggctgagctgctatggctccgccctttggagattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactatt

SEQ ID NO: 117787 - DNA, 3019 bp, Homo sapiens
  Payload ID: 3016
  Gene Symbol: C1orf101
  Gene Name: chromosome 1 open reading frame 101
  Uniprot ID: Q5SY80
  ENST ID: ENST00000366533
  CDS Start-End: 43-2541
cgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaa

SEQ ID NO: 117788 - DNA, 3333 bp, Homo sapiens
  Payload ID: 3016
  Gene Symbol: C1orf101
  Gene Name: chromosome 1 open reading frame 101
  Uniprot ID: Q5SY80
  ENST ID: ENST00000366534
  CDS Start-End: 55-2910
gcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaatcctttgtaagaatgaaagtgaatttttgaaaatatatctatgtgtcaagtatcattttgcatgaaacttttcacatgaaaccttatatgactgtagttaatttatatataaaggatttaataaaggtgtgtggatttaaataa

SEQ ID NO: 117789 - DNA, 2895 bp, Homo sapiens
  Payload ID: 3016
  Gene Symbol: C1orf101
  Gene Name: chromosome 1 open reading frame 101
  ENST ID: ENST00000428042
  CDS Start-End: 1-2616
cggaggcggagcaggcgccatgtcagcccgggaagtggccgtgctgctgctgtggctgagctgctatggctccgccctttggagattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttaggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaa

SEQ ID NO: 117790 - DNA, 888 bp, Homo sapiens
  Payload ID: 3017
  Gene Symbol: C1orf105
  Gene Name: chromosome 1 open reading frame 105
  ENST ID: ENST00000367725
  CDS Start-End: 130-651
ggacaattccctctccattcctgttattgctgctgagctggtcgtaaggaaaccgagtgagaagggaatgcaacagaagaaaaagaccaaagacctgggtttcagggctgggaaagaaagcaagacagaatggaggaaatgaggcctgcaggacatggcgtctcaaatgtttgcgtcgcctttaaagtagcctgtcacagctgccttccacgactcttcaatgccctcatcccttctccagatagaaatggagcagctcttcttggaggccaggcttcagctgatagcaagtctgaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacagaaagcattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatggaaca

SEQ ID NO: 117791 - DNA, 985 bp, Homo sapiens
  Payload ID: 3017
  Gene Symbol: C1orf105
  Gene Name: chromosome 1 open reading frame 105
  Uniprot ID: O95561
  ENST ID: ENST00000367727
  CDS Start-End: 199-750
atgtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaaggcttctgttccaaaatttgacaagattccttggcttagtgaggccagccttgtaaacaagccattagtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacagaaagcattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatggaa

SEQ ID NO: 117792 - DNA, 394 bp, Homo sapiens
  Payload ID: 3017
  Gene Symbol: C1orf105
  Gene Name: chromosome 1 open reading frame 105
  ENST ID: ENST00000488100
  CDS Start-End: 1-378
gtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacaggatctgtccacaacatatggctgaagactttccatggagatggggtacaaacaaaataaaagttcccctattggc

SEQ ID NO: 117793 - DNA, 462 bp, Homo sapiens
  Payload ID: 3017
  Gene Symbol: C1orf105
  Gene Name: chromosome 1 open reading frame 105
  ENST ID: ENST00000460397
  CDS Start-End: 153-266
gaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaagatatattccaagcacacagaacagtatttgtcatacagcctgaatccttgtgccagcagcccacaaagaggcatgccacagtatcaaaattaagccaattaataaccctgcaatggcttttaactgttcaaatgaagagttgcacatctctcattttaaatcaaaagtagaaatgattaagcttagtgaagaaggcatatcaaaagccgagacaggctgaaagccaggcctcttgtgacaaacagccaagttgtgaatgcaaataaaaagttattgaaggaaattaaaa

SEQ ID NO: 117794 - DNA, 4298 bp, Homo sapiens
  Payload ID: 3018
  Gene Symbol: C1orf106
  Gene Name: chromosome 1 open reading frame 106
  Uniprot ID: Q3KP66
  ENST ID: ENST00000367342
  CDS Start-End: 201-2192
ggggcaaaggggacagcctcgcccctcgagcggctgctcccgcagctcgctcacccctgcgggtacgtcgtcactcccgcgtgcggccccgtcccgactcttggatcggactcttcagtcccttcttgcgtcttcccctctttcctctgggccttggtatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 117795 - DNA, 2197 bp, Homo sapiens
  Payload ID: 3018
  Gene Symbol: C1orf106
  Gene Name: chromosome 1 open reading frame 106
  Uniprot ID: Q3KP66
  ENST ID: ENST00000413687
  CDS Start-End: 362-2098
attagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcag

SEQ ID NO: 117796 - DNA, 708 bp, Homo sapiens
  Payload ID: 3018
  Gene Symbol: C1orf106
  Gene Name: chromosome 1 open reading frame 106
  ENST ID: ENST00000451872
  CDS Start-End: 339-708
ccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcc

SEQ ID NO: 117797 - DNA, 570 bp, Homo sapiens
  Payload ID: 3018
  Gene Symbol: C1orf106
  Gene Name: chromosome 1 open reading frame 106
  ENST ID: ENST00000532631
  CDS Start-End: 450-570
ggagtgggagtgggccggggccagggccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccc

SEQ ID NO: 117798 - DNA, 2355 bp, Homo sapiens
  Payload ID: 3019
  Gene Symbol: C1orf109
  Gene Name: chromosome 1 open reading frame 109
  Uniprot ID: Q9NX04
  ENST ID: ENST00000358011
  CDS Start-End: 191-802
gagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggtaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagca

SEQ ID NO: 117799 - DNA, 608 bp, Homo sapiens
  Payload ID: 3019
  Gene Symbol: C1orf109
  Gene Name: chromosome 1 open reading frame 109
  ENST ID: ENST00000477060
  CDS Start-End: 183-608
ggggcctactaggtcaggtcggctgtaggattctgctccagggttggcggctgcttctttctggcctggctgccactgagtagccgaggggccgccgtgaccctctgactgattgactggctggctgcctacgtcggcgctcctcagggccccaagctcctcaggccgaacttcggcagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttg

SEQ ID NO: 117800 - DNA, 852 bp, Homo sapiens
  Payload ID: 3019
  Gene Symbol: C1orf109
  Gene Name: chromosome 1 open reading frame 109
  ENST ID: ENST00000486637
  CDS Start-End: 512-852
cgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggtcaggaaccccgtctactaaaaatacaaaaattagccaggcgtgttggcgggcacctgtattcccagctactcgggaggctgaggcaggagaattgcttgaacccgggatgcggaggttgcagtgagccgagatagcgccactgcactccagcctgggcgacagtgagactccgtctcgaaaaaaaaacaaaaaaaaaaccctgcttctggagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatga

SEQ ID NO: 117801 - DNA, 763 bp, Homo sapiens
  Payload ID: 3019
  Gene Symbol: C1orf109
  Gene Name: chromosome 1 open reading frame 109
  ENST ID: ENST00000461359
  CDS Start-End: 309-763
gagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtc

SEQ ID NO: 117802 - DNA, 612 bp, Homo sapiens
  Payload ID: 3019
  Gene Symbol: C1orf109
  Gene Name: chromosome 1 open reading frame 109
  ENST ID: ENST00000491981
  CDS Start-End: 39-612
ccaagctctggagggctgggggcctactaggtcagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaag

SEQ ID NO: 117803 - DNA, 717 bp, Homo sapiens
  Payload ID: 3019
  Gene Symbol: C1orf109
  Gene Name: chromosome 1 open reading frame 109
  ENST ID: ENST00000488137
  CDS Start-End: 443-717
gtggcggctctgcaataccccaagctctggagggctgggggcctactaggtcaggtcggctgtaggattctgctccagggttggcggctgcttctttctggcctggctgccactgagtagccgaggggccgccgtgaccctctgactgattgactggctggctgcctacgtcggcgctcctcagggccccaagctcctcaggccgaacttcgggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgagcagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggct

SEQ ID NO: 117804 - DNA, 919 bp, Homo sapiens
  Payload ID: 3019
  Gene Symbol: C1orf109
  Gene Name: chromosome 1 open reading frame 109
  Uniprot ID: Q9NX04
  ENST ID: ENST00000464085
  CDS Start-End: 296-907
ggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgagcagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcg

SEQ ID NO: 117805 - DNA, 2570 bp, Homo sapiens
  Payload ID: 3019
  Gene Symbol: C1orf109
  Gene Name: chromosome 1 open reading frame 109
  Uniprot ID: Q9NX04
  ENST ID: ENST00000494120
  CDS Start-End: 419-760
ctggagggctgggggcctactaggtcaggtcggctgtaggattctgctccagggttggcggctgcttctttctggcctggctgccactgagtagccgaggggccgccgtgaccctctgactgattgactggctggctgcctacgtcggcgctcctcagggccccaagctcctcaggccgaacttcggggttggattgctcaagagttgtgctgagacccagaaggctagaggctagtttcgaagctgtagctcaggctgagtctcaaggcgggcggcgactggacggccagaccggcgagctcttgacgggaaggcgaccggcagcctcgggcaggggagacaggactgtatgtcagagaagagacggcgcttggacgccaggaatcctctgaagcaggagactgccctatccagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcactgcattttcttttgagcagtccttaacttccagaaaggtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggtaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagca

SEQ ID NO: 117806 - DNA, 559 bp, Homo sapiens
  Payload ID: 3019
  Gene Symbol: C1orf109
  Gene Name: chromosome 1 open reading frame 109
  ENST ID: ENST00000619962
  CDS Start-End: 447-559
aggccttgtggcggctctgcaataccccaagctctggagggctgggggcctactaggtcaggtcggctgtaggattctgctccagggttggcggctgcttctttctggcctggctgccactgagtagccgaggggccgccgtgaccctctgactgattgactggctggctgcctacgtcggcgctcctcagggccccaagctcctcaggccgaacttcgggcaagcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgagaagatgactcaagaccggcctctgcttgccgtgcaggaggcgctgaagaagtgcttccccgtggtggaggagcagcagggcctgtggcagagtgccctgcgggactgccagcccct

SEQ ID NO: 117807 - DNA, 1711 bp, Homo sapiens
  Payload ID: 3020
  Gene Symbol: C1orf111
  Gene Name: chromosome 1 open reading frame 111
  Uniprot ID: Q5T0L3
  ENST ID: ENST00000367935
  CDS Start-End: 81-866
agaatgtttatcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagcgctctcaccagactgcagcttgggggatacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttctgtccagtctgaggtcaccccgcacagcctgctgtccttcccagaacccggctctcatcacctttggctaatggttgcctagcaacaccaggcacacaccctcccctttctctcttttaaaaataaagacaatacttgaagtttgggaaaatcatctaagatagaggttctcaaaggtgcccagctggcagtaccagcaacccctgggaactctcaggccctcctcagacctactgaatcagaaactatgggtctggggctggcggtctatgtcctaaccagccctccaggtgactctgatgcagctcagctgtgagaagcactgctctaggattctggcctctgcttggtccctatgtggtcagtccttgccccaccctgggaagaaggggctggatgccctttcctatttgcatggggaagaatctctgcagttttaaaggcttctttgacggtagatcttctgaggggggaatgtggaggaaaatatgcctctgagtataaggcaggtaagaggcagatggggctgagctcacccgggactgagctctcaggcactaccatcattcacttagaacagccatccagtgctggggcagaatagaatcagttttgacccaggagacgtcttttcttggctgctttgagccaggtgaaaataggcaggtaaacatgggaacctattgcttcctgttaccaagtaatgtgtccagtgggcagccctgactctgcctccatttctgagtgaacctcctggtccatctgacccagaaagatggataagcatcagggatgcagcagagacatctatctt

SEQ ID NO: 117808 - DNA, 447 bp, Homo sapiens
  Payload ID: 3020
  Gene Symbol: C1orf111
  Gene Name: chromosome 1 open reading frame 111
  ENST ID: ENST00000493255
  CDS Start-End: 19-141
ccccgcagtggtcagaatatggagaacttctcactcctcagcatctctggacctccaatctcttcctccgccctgagtgcttttcccgacattatgttctctcgtgccaccagcctgccaggtaaactttggtgccactagggccacaaagatgtggttttttttgaagcttttaattgagtaccctaccagatcatgttacaggaccatgatttagtgagaaagtcaaattacgcatggggagaaaataatttttcaaaatgctgcatttgtgactgcagcttgggggatacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctt

SEQ ID NO: 117809 - DNA, 800 bp, Homo sapiens
  Payload ID: 3020
  Gene Symbol: C1orf111
  Gene Name: chromosome 1 open reading frame 111
  ENST ID: ENST00000620601
  CDS Start-End: 43-774
agagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagcgctctcaccagactgcagcttgggggatacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggcagaaggcccggctgggagacaggctctcctccggcagctgccaggccttcaatagtcctgctgaacaccttaggcaaattg

SEQ ID NO: 117810 - DNA, 4355 bp, Homo sapiens
  Payload ID: 3021
  Gene Symbol: C1orf112
  Gene Name: chromosome 1 open reading frame 112
  Uniprot ID: Q9NSG2
  ENST ID: ENST00000286031
  CDS Start-End: 701-3262
ggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatcccttttttttctttttcaaataaaaaggttacaatagctcattaaacaaa

SEQ ID NO: 117811 - DNA, 4002 bp, Homo sapiens
  Payload ID: 3021
  Gene Symbol: C1orf112
  Gene Name: chromosome 1 open reading frame 112
  Uniprot ID: Q9NSG2
  ENST ID: ENST00000359326
  CDS Start-End: 348-2909
ttccggtctgggctttggcgggtctggtttgaagctctcctgtttgacgaaagtatgtctcaggaaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatcccttttttttctttttcaaataaaaaggttacaatagctcattaaacaaa

SEQ ID NO: 117812 - DNA, 2661 bp, Homo sapiens
  Payload ID: 3021
  Gene Symbol: C1orf112
  Gene Name: chromosome 1 open reading frame 112
  Uniprot ID: Q9NSG2
  ENST ID: ENST00000413811
  CDS Start-End: 1019-2611
acattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatac

SEQ ID NO: 117813 - DNA, 3413 bp, Homo sapiens
  Payload ID: 3022
  Gene Symbol: C1orf115
  Gene Name: chromosome 1 open reading frame 115
  Uniprot ID: Q9H7X2
  ENST ID: ENST00000294889
  CDS Start-End: 559-987
actttttcactgagtcagaccgttgaacaccgtggacacactgtcttgcgtttccgaatatttcctagaatacggacgtttcctaagactcacgataaagattttctgatcgtctctccaaaaccttgccaccaatttgcactcccacgaatcctgttaccgtgactatctcgccatgccctccctagcactgagcgtgatctctagtatcattttccatcgttgctaatttgaacatgagcagatggagtcctattatttggggtcattaatttcgtagcaagtgcagttgaaggtgttttgcatgttcattgtgcagtgcgcgccgtagtctgcacagtttggccggcaggtgggatgaagggcggggctggcggagcgcgcccgccgcctggtaggccagttcggagcggagccaacgctatcccgggccccacggccagggggcgctgcggcccccccaatcccccgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaatgtt

SEQ ID NO: 117814 - DNA, 5493 bp, Homo sapiens
  Payload ID: 3023
  Gene Symbol: C1orf116
  Gene Name: chromosome 1 open reading frame 116
  Uniprot ID: Q9BW04
  ENST ID: ENST00000359470
  CDS Start-End: 251-2056
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaatagttattgctgtggcttttaattttatctttggaagatagctatatggtaactcatcattaaccagaacacctctcccctcaaattccgtgaccaagttgtgcagcttgagcaaatgccgaaagagggtattatgggtgggtggtgtgggcttgcaaatacaagcttggaggtgagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactacc

SEQ ID NO: 117815 - DNA, 3142 bp, Homo sapiens
  Payload ID: 3023
  Gene Symbol: C1orf116
  Gene Name: chromosome 1 open reading frame 116
  Uniprot ID: Q9BW04
  ENST ID: ENST00000461135
  CDS Start-End: 812-1879
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggagagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaa

SEQ ID NO: 117816 - DNA, 973 bp, Homo sapiens
  Payload ID: 3024
  Gene Symbol: C1orf122
  Gene Name: chromosome 1 open reading frame 122
  Uniprot ID: Q6ZSJ8
  ENST ID: ENST00000373042
  CDS Start-End: 260-592
gccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctc

SEQ ID NO: 117817 - DNA, 2229 bp, Homo sapiens
  Payload ID: 3024
  Gene Symbol: C1orf122
  Gene Name: chromosome 1 open reading frame 122
  Uniprot ID: Q6ZSJ8
  ENST ID: ENST00000373043
  CDS Start-End: 1707-1850
gtaaggcaaggggaaagggatcatgagaaaggttggaagggataagagggtaagtcttatctggatcctagtgaaagccaagtggcctggagtctggggacacaagagaaaacttgactcacaggcgtaaaagggtttaggtccttgttgagctcctccgagcgttccatcaccagggtcactggtcctggcagtaggtctttcaggagcccctcaggtactctcacacggcagtatctgggaaacacagaagaataaatccattcaaaattgaagggccactggtggtcctttcctagactctaggcagacgtagaaaaggaatccttcgagtttacaatgggagccgcctgtctccctgcttcacctccctaagagcttgagcagaaagcagggctccagaggcgcacccctggcttgacgcccatgtgcctctggtctcagggactacaacagctgcaccgctgtgatatcatgatagtgggatcaagctccacgttttattttcttcaaggcattcgctattaaattaagctactgtgtttgtttgcttttttcccgggggcctccccaattagcacaaatacgccaagggaacagggtccctgcctttctcgtgtgttgctgcttcccagcagcatgtagttcagggcccggggcacgttaagtcctcggtacatatttccagttccggattccttggtgagcctggacaagcccctcccgctctctgcgcctcagtctcccaagcctgtcaccggaaacccctcccgcggtgccgcccctagcggggccgggtcggggcggccttacctgtagacgtcggccacgcggccgaggcatacggccagaggcttggcctcgctgcgacccttgaggcggtacacagcgcgcagagccgccgagcagctcgccgcgcaggccaggccgtacagcgtatcggtggggacggccaccacggcgccggcgcgcagctcggccacggcggcccgcagcgcctcggtccagccggcgcgctccgggctcgcggcctgcacggccccgctccccgggagccgcaacagccgggcgccgggggccgccggagcgggactcggcgggcggaagaggcgaccgctccgggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactc

SEQ ID NO: 117818 - DNA, 1234 bp, Homo sapiens
  Payload ID: 3024
  Gene Symbol: C1orf122
  Gene Name: chromosome 1 open reading frame 122
  Uniprot ID: Q6ZSJ8
  ENST ID: ENST00000468084
  CDS Start-End: 715-858
tcccgcggtgccgcccctagcggggccgggtcggggcggccttacctgtagacgtcggccacgcggccgaggcatacggccagaggcttggcctcgctgcgacccttgaggcggtacacagcgcgcagagccgccgagcagctcgccgcgcaggccaggccgtacagcgtatcggtggggacggccaccacggcgccggcgcgcagctcggccacggcggcccgcagcgcctcggtccagccggcgcgctccgggctcgcggcctgcacggccccgctccccgggagccgcaacagccgggcgccgggggccgccggagcgggactcggcgggcggaagaggcgaccgctccgggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccgggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcaga

SEQ ID NO: 117819 - DNA, 1085 bp, Homo sapiens
  Payload ID: 3025
  Gene Symbol: C1orf123
  Gene Name: chromosome 1 open reading frame 123
  Uniprot ID: Q9NWV4
  ENST ID: ENST00000294360
  CDS Start-End: 43-525
aacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 117820 - DNA, 2761 bp, Homo sapiens
  Payload ID: 3026
  Gene Symbol: C1orf127
  Gene Name: chromosome 1 open reading frame 127
  ENST ID: ENST00000377004
  CDS Start-End: 1-2472
atgtgggggtccccagcacttgcctgggccgtctggcttgcctgtgttcagcccacggtgttcccatggagcctctccttcaggtcagacacggacaagccaagctctgcagcagaagttttaacagaagcatcttcttgttggacagacacagttgagtgcttctcagactacatgaccctgtggatcccaaggagccacgtggaggggctgaggcggtggctggccaggaccttgcacttgccaggcacctggaggtcccctgaccacctggattcttctcttgctaaatgtggctacttcctgcatctggcttcagacggtgacttcctttttcgagttcaatactcggcctgctttgtgcagaaagagaaagcaaattacaggctggaaatcagaatatttcagaaaggggtgatggggttggagcggagtgatcgctacataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtgctgaacacctctgctgagctcctgccactatggctggtgagcggtcaccatgcctattctttagaagctgcttgcccaccggtgtcattccagccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagtcgcctgcctcaactgctgcactgaggaccactccctccccaccatccccaggaccagagacccctccagcgggagtgccacctgctgcttcctcccaggtgtgggctgcaggaccagctgcccaggaatggctttctcgggacctcctgcaccggccttccgacgcactggccaaaaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacagccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatcagg

SEQ ID NO: 117821 - DNA, 2265 bp, Homo sapiens
  Payload ID: 3026
  Gene Symbol: C1orf127
  Gene Name: chromosome 1 open reading frame 127
  ENST ID: ENST00000418570
  CDS Start-End: 1-1976
acataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtcagtggtgggcagcaggctctgccaggagtgtcattccagccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagtcgcctgcctcaactgctgcactgaggaccactccctccccaccatccccaggaccagagacccctccagcgggagtgccacctgctgcttcctcccaggtgtgggctgcaggaccagctgcccaggaatggctttctcgggacctcctgcaccggccttccgacgcactggccaaaaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacagccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatcagg

SEQ ID NO: 117822 - DNA, 2359 bp, Homo sapiens
  Payload ID: 3026
  Gene Symbol: C1orf127
  Gene Name: chromosome 1 open reading frame 127
  ENST ID: ENST00000520253
  CDS Start-End: 1-2327
ggagcctctccttcaggtcagacacggacaagccaagctctgcagcagaagttttaacagaagcatcttcttgttggacagacacagttgagtgcttctcagactacatgaccctgtggatcccaaggagccacgtggaggggctgaggcggtggctggccaggaccttgcacttgccaggcacctggaggtcccctgaccacctggattcttctcttgctaaatgtggctacttcctgcatctggcttcagacggtgacttcctttttcgagttcaatactcggcctgctttgtgcagaaagagaaagcaaattacaggctggaaatcagaatatttcagaaaggggtgatggggttggagcggagtgatcgctacataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtgctgaacacctctgctgagctcctgccactatggctggtgagcggtcaccatgcctattctttagaagctgcttgcccaccggtgtcattccagccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagtcgcctgcctcaactgctgcactgaggaccactccctccccaccatccccaggaccagagacccctccagcgggagtgccacctgctgcttcctcccagaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccc

SEQ ID NO: 117823 - DNA, 340 bp, Homo sapiens
  Payload ID: 3026
  Gene Symbol: C1orf127
  Gene Name: chromosome 1 open reading frame 127
  ENST ID: ENST00000468348
  CDS Start-End: 1-208
tccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggacgcccacctccaggcagacccatcactggaagtgggatttgaaatgcagccaagaagaggagaccgtcggcaacgcccgcccggaacaagaaataaataaataaataatca

SEQ ID NO: 117824 - DNA, 2483 bp, Homo sapiens
  Payload ID: 3027
  Gene Symbol: C1orf131
  Gene Name: chromosome 1 open reading frame 131
  ENST ID: ENST00000318906
  CDS Start-End: 30-779
acccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggtgagtgattttatcaggtcctggggttgaacaatctggatgaacctactgatgagttctgacaaggacgccttgaatgtatgtggtgttgctagcccattagagcgcttcactgtctctcatttatccttgtcaaagtaggatttagtaaactgcccaagatcaaacaactgcctgagaactgaattaggaagtttctccaatcttccacttttcaccgacactctaagtgactagtggaaaagctgcagtttacatttccaagaaaagacttctaagagtgctgctacagcagcgtagtctgggtctgtatagcctgctctttgacataccacgtaagatagagcaccgtaattatgaataagggatgttgactttgttgctttatacttgtttgttagcttttgttcaaatgcctttttctctgtctttgagttactgtttcagaatggactctttttgtcttagcctgttttcttgggctcctagtgcacttgtacatgctgtaaaatggtcatttgttctggccaccgatctgtatctgttgaatgcctctttgtgccaggcatgtgggtgtcttaggtattggtgtacagctgtaatcacactaaagatatccctgcccttgaggagcttcattgtagggagagaaacaccccaaaacatacaaatggataagtaagatgatatcaggtactggcaagtattgtagagaggctgaaagagagcattgtgaaggaaaaccacagggagaaggtgagctgggaaattagtctgaggaggtgacatcggagctgagaactgaacaaagaagaggggcagcctggaaagagctggtagcagaacattccttgcagaagaaaccagtgcaagggccctgaggcaggaaggcagtagcatgtttcagggaccacaggaaggcgtatggggtggggggtgtgcatggcaggcgaccaggagtttgcaggccagactgcagtggcctggttggtggtactgtgatgcttgttggtaagcttgactatttatagtacctttctcttactttaaatgtaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 117825 - DNA, 1424 bp, Homo sapiens
  Payload ID: 3027
  Gene Symbol: C1orf131
  Gene Name: chromosome 1 open reading frame 131
  Uniprot ID: Q8NDD1
  ENST ID: ENST00000366649
  CDS Start-End: 27-908
cggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 117826 - DNA, 1432 bp, Homo sapiens
  Payload ID: 3027
  Gene Symbol: C1orf131
  Gene Name: chromosome 1 open reading frame 131
  Uniprot ID: Q8NDD1
  ENST ID: ENST00000366651
  CDS Start-End: 38-916
gtcgcggaacccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 117827 - DNA, 795 bp, Homo sapiens
  Payload ID: 3027
  Gene Symbol: C1orf131
  Gene Name: chromosome 1 open reading frame 131
  ENST ID: ENST00000451322
  CDS Start-End: 1-771
gggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgagg

SEQ ID NO: 117828 - DNA, 2053 bp, Homo sapiens
  Payload ID: 3028
  Gene Symbol: C1orf141
  Gene Name: chromosome 1 open reading frame 141
  Uniprot ID: Q5JVX7
  ENST ID: ENST00000371006
  CDS Start-End: 22-1224
ataggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaatt

SEQ ID NO: 117829 - DNA, 2153 bp, Homo sapiens
  Payload ID: 3028
  Gene Symbol: C1orf141
  Gene Name: chromosome 1 open reading frame 141
  Uniprot ID: Q5JVX7
  ENST ID: ENST00000371007
  CDS Start-End: 111-1313
agatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaattaactaacaaaa

SEQ ID NO: 117830 - DNA, 973 bp, Homo sapiens
  Payload ID: 3028
  Gene Symbol: C1orf141
  Gene Name: chromosome 1 open reading frame 141
  ENST ID: ENST00000448166
  CDS Start-End: 112-973
gagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatg

SEQ ID NO: 117831 - DNA, 2079 bp, Homo sapiens
  Payload ID: 3028
  Gene Symbol: C1orf141
  Gene Name: chromosome 1 open reading frame 141
  ENST ID: ENST00000475209
  CDS Start-End: 22-675
ataggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaaggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaatt

SEQ ID NO: 117832 - DNA, 1580 bp, Homo sapiens
  Payload ID: 3028
  Gene Symbol: C1orf141
  Gene Name: chromosome 1 open reading frame 141
  ENST ID: ENST00000544837
  CDS Start-End: 152-508
gcggggcgagtaacccgcggagccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagtgatcttttaaaagtaggctgatcctgattaaagcctcttcagcggattctcattgtacttagtatgaaacttgtacttcttacaaagacctggccgggcacggtggctcatggctgtaatcccagcactttgagatgccaagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaaggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaa

SEQ ID NO: 117833 - DNA, 736 bp, Homo sapiens
  Payload ID: 3028
  Gene Symbol: C1orf141
  Gene Name: chromosome 1 open reading frame 141
  ENST ID: ENST00000603691
  CDS Start-End: 152-736
gcggggcgagtaacccgcggagccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaa

SEQ ID NO: 117834 - DNA, 4179 bp, Homo sapiens
  Payload ID: 3028
  Gene Symbol: C1orf141
  Gene Name: chromosome 1 open reading frame 141
  Uniprot ID: Q5JVX7
  ENST ID: ENST00000621590
  CDS Start-End: 22-264
ataggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatctcaaattgaaaaaaaacctaggaaaccattggattctgttggtctcttagaaggtgatagaaataaaaggtaatttattttaaaatgcttaatactttgttctgtttaatgatgtttctagtaggacacattttataattgacaggaataaatttattctgccttattatttagttccacagcacaatccaatgaatggtccaagactgcttagccactagatatcacatccagaccttgagtattgttaaatggagagaaaggcatggaaaaatgaatagagggaatacaatttttttttttagtaaatacacacatttacttacatgacaacatggacatgaaaaagtagcttttctttggataaagttctcatttttctcatgaacccttccatctctgtataatgaaaaaaatcattaatccagtgtgtttcaaactttgtttgaatcaataatgaacaagcactttaggtttaactcagtttaaaaattatatcctgtctctgcctgaccacactattctatcctcttaacaaagctggggccaccctatgttggcatgaagctgccctgtggagcttcttccagaatttcaacataggacgttgcaaatacctctctacctttggtgttctcctcaacctacgtaataatacaactcgtccccactcaaaatccaaagaggcatatatatgactctcttgcttccactcctactcttgctgttttctcccacaaaccaggcaggacgggatgatcttgtcggtttgaaaagtctgtgggagagaggttggtgcagaagttggcagtgacttccagggataaaaggaggcagacaagaactgacaagctgtaatcagccccatgaacactaccctgaactgtgtttattttcagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggtaataagcatatcatctattgttaagtaaatatgtgtagtcataagacttatgggaatcacccatatattttagtgaccagaatctttgataaatcctttttacctcttggtttcatattccaaagtgataacagcacttaagttcttaatgcactttgcacaactcccaaaccagggattcctttataccagctgaaaattcagtgtttttctttatgaagaagcctttatcaaatttgcttgattataatagaactgtagaataaaaagaattttttaaaaatggctgtaccaatctagcagaatgcagtggtgtgcacctgtaatccccgctactctggagtctgaggcaggggaactgcttgagcccaggcatttgaatccagcctgagcaatataacaagaccccagttctaaaatgatgggaccatgaccatgtgtcaatttttctaacaatctgttttggctttttcaaccagaaagtgcatttattaaaggctatttagtaactcatgctctctagagaggcaatatggctcgaaagctgtctagtcaggaatcacctaattatatagccccagactgctccactgaggcccatgctattgtcacagataaaagtttacaactctgatgctgagcagggaatactctaagacatttgctactgctgtcattcaaagctagatgtaactcctaccaccctcactagaatagttttcccaatactttttcacagtgcttgctttctctgaactgaagacttcataggtgtatctgaatggcagagcctagggcaaatgcctatgtcctaaccgcaaagaagctgataaacatggttcttgcctctacctaagggtacatagacttgtcaagtggaaaattccctaaggtgttggacagaccaaaagcattacaaacatccattactatggctaaataggtaatattggcatcaccagtggattgcaaaactagatctttgtcatcttttcagtaatcatagcagacttggatattactgcgataaaaatgtctattcttaagtcaatctattactttggctattttattccacaaatatatattgagcactttttaggtgtcaggtattgtgctaagtattagggtacaataataacagttgtagagataatttttaattttttgaattacttactagaatatccagatttgtaattttggcttgtaatcagttatgtctcttctgaactttgactcaatccattttttggtatgctttttaatttctagaacatggaaacctaagaaatgccagaacaaccaccttatttctcaatgacagtaccccagatatttaacaaatatattaattttttcgtattccaatttatttcaaaaaacatttaaggccaaaagttcaagttttatcactaacatctctatagaatattaagataagaaggatgtatgttacatacaagtacagtattttcatgtatttgaataatgctactgttcatattaaatatttgtatgtagtcatttttagaatattttacaattttatttacatgttttaaaatatatggagctttcttgactcaatgaacttatgactaattattcttttctttaatctacaggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatcctt

SEQ ID NO: 117835 - DNA, 889 bp, Homo sapiens
  Payload ID: 3029
  Gene Symbol: C1orf145
  Gene Name: chromosome 1 open reading frame 145
  Uniprot ID: Q96MR7
  ENST ID: ENST00000295012
  CDS Start-End: 1-342
atgtacaccgcgtcgtcgtcggccgagacattgcgcacggtcaggcggcgctcggtgccctcctcctcgatgccgtacttggcgctcgcccacaaccgcgtctcctccttgaaccacgcggcctcagtggacggctggggcacctcacataggaacgtggccgactccttctcccgcacctccagatcttgcagccgctttttgaagggaaccgcgggctctgccaggagagaagactgctattttgaagcatacatgggaagctggttcctggacccccgcatataccaaaatctgtgcatactcaagttctacggtcagccctgtggaacccaagcataggacaagccggccctccctatacacacaggtttgacatcctgagaacactgctggttcccttcccatttggttccagaaaatctgcgtataagtggactcagtggtgcaaacctatgttgttcaagggtcaactatatatgatgaattattgttacctacagtcactctaccatgctactaaacactagaactgattcattttctctgactgtgtgtctctacccattaaccagcccctcttcatctcccttcccgcttccctccccagcctctggtaaccatcattcagttctctacctccgtgaaatcaacatgagtaagaactggtgaaacccaaacatagtctcgaatttagctttttttttttttttaactgtaagaggctaaacattcttgaggaggacacaaaaaagtctgaagacaactgtccagatgagaatcttgcacttgcacaagtagagaggagagttagtttttataccatcgcatccccaatcccagctttattgatgcataacaaataaaaattgtacatatttaaagtgta

SEQ ID NO: 117836 - DNA, 2893 bp, Homo sapiens
  Payload ID: 3029
  Gene Symbol: C1orf145
  Gene Name: chromosome 1 open reading frame 145
  Uniprot ID: Q96MR7
  ENST ID: ENST00000337335
  CDS Start-End: 5-481
gcagatgtacaccgcgtcgtcgtcggccgagacattgcgcacggtcaggcggcgctcggtgccctcctcctcgatgccgtacttggcgctcgcccacaaccgcgtctcctccttgaaccacgcggcctcagtggacggctggggcacctcacataggaacgtggccgactccttctcccgcacctccagatcttgcagccgctttttgaagggaaccgcgggctctgccaggagagaagactggaacggacacctgcaaccctggattccacgaccggacagacgcgggtgggaaacggcagaccgcaagggcgaaaggacccaggtgcacgggttgcggaggagcctgggcccgcgcgccccgcacccaggagctcaccgcgcactacgaccagcacagagctgtaggtctggcccacgaggttggacgccgtgcaggtgtagaggccgcggtccgactgcttgcagaagaggatcttgagcacgaagttctcctgcgcgtcctcgtacaccacgtggcgccggccctcggtcaccagctggccgtccttcttccacaccgtctcgggcttgggctcgccggtcacgtagcagctgaggcgcgcgtgcttgccttcagtcaccgtgcaggtgcctgctgtcccagctactcaagagactgaagcaggaggatggcttgagcccaggaggtcaaagctgcagtgagctgcttcgccccatccctgatccagtgccaggcctctatgtgtcctcacagcgtacctcaggctcttccgggcaatggccaacatctctcatgtgtcctcaatcagaaggagggtgaggggtctctggagtaacggttatgccattctgcagccttatctcatgactgatcacttccaaaagctcacgttctaatcctgtcaccttgggggtgagcatttcaacgtgtgaatctccgggacacacattcagtccacagcaccagggagaaaggaaaggctggaaggagagcccactcccccaccaggagcttggccctgagctgccccagccatgcagaagtgtgtgtgcattgtgtgtgctcgaatacgtgccccaccccctcccggacagggccgtggagggtgcagagaagatggctgtgcgggccagccccttgcagggcctcctggacctgggagaagcaatgcccccacagcctccaggagtggcctgccctcctgaccctcttcactgctgcctgctccgctgcatctccaaacaccactgccagccttcaggctggattttctgcctccttcacaggacccctgttgttccttatttccctgcaacgtatttgttgaagacagtgggatattcacactacagagcttccggaggcactgtgcccagggtgtccttcacaccacgggaggccacaggatgcagtggctggccatggaccttgcctattcctggctggaatccactgcaaagagaactttcatggagctgctgtctgttcaaaggggtacaggtggaggaggagcagacacaatttcctgaggaaagcaaatgtcactgtgtcccttgagttgccagcttccacagggatgtcccgccatgagccctcctcccaggggctttcacagctgggtgggctggcatcctgggtgcagtttaactgaagggggtgttctcacagccatctcccaaggcctgggggatggtgggcccggaggcctcagacctgcacctgctgcccaggcgatggggtggctgggccccgggtgcccacaaactataggcaaaaaaaactgtaagtcagtcctgcagggtttcctgaacattttatgatccccaagtcgtatctgaacatgtcaagaatctctggtgccttggcttgggtgtaaagatgaagttctttcctcctctgtattccaggaggaaagagggttttcattcccttctgaatgttaggagggaaggcattttccatccttgaccagcttgtagatgacacacattcagcaaacgcacatcccagcagcaccgagagaacacacaggtgtgtcacgcttttgcgttcataaggccttttcatgtcagtatcttattagatattcccaaacaagggtgttttctcatcttatagaagagaggcctgaggctcacagggtgaaaacaatttgcttaagcctgcacagcagctgtgctggcaacgtttctcccggtataaatgagaagcagcctttgtggccacagagatgtgactgctaagtgcatcgtcccaccctgaaggagattcttcctcaacaagaggacattagtgcaaagactgatgaagtctgtagtttcgtgggttttttttttaagcataaggggttaaatattatgtaattaagtaataaggcagttgtgaggatgcaactgccaaaagtttgaaaaaagctgcccagatggaaatctgcttgcatttgtgcaagcagataggtgagggatttttactgtactgccgtgtcccctacctgccccagctttattgagttataattgacaagcaaaaattgtttatatttaaagtgtacaatgtgatgtggcctttttgttttgttttgagacataatcttatcacccaggctggagtgaagtggcgcagtttaaactgcgcaggctcatcatcctccttcctcagcctcctcagtagctagaaccacaggtgtgagccaccatgcctggctcattttttgattttctttttttaagagacaggggtctccctgtttcccaggctggtcttgaactcccgggctcaagtaatcatcccgcctcagcctcccaaagtgatggtgttacaggcatgagctactgtgcctggccagaaatggtaaattataattaaaggcttctgtaagtcatgctgtca

SEQ ID NO: 117837 - DNA, 624 bp, Homo sapiens
  Payload ID: 3029
  Gene Symbol: C1orf145
  Gene Name: chromosome 1 open reading frame 145
  ENST ID: ENST00000472613
  CDS Start-End: 1-286
gtcgtcggccgagacattgcgcacggtcaggcggcgctcggtgccctcctcctcgatgccgtacttggcgctcgcccacaaccgcgtctcctccttgaaccacgcggcctcagtggacggctggggcacctcacataggaacgtggccgactccttctcccgcacctccagatcttgcagccgctttttgaagggaaccgcgggctctgccaggagagaagactggaggaaagagggttttcattcccttctgaatgttaggagggaaggcattttccatccttgaccagcttgtagatgacacacattcagcaaacgcacatcccagcagcaccgagagaacacacagctgggttgcttacaaatacactacttcaaagtaaactttctctagtagcatatcagaagcaaagtaaaatctatttggagcaagtaaatctgactgctaccccactattttgaagcatacatgggaagctggttcctggacccccgcatataccaaaatctgtgcatactcaagttctacggtcagccctgtggaacccaagcataggacaagccggccctccctatacacacaggtttgacatcctgagaacactgctggttcccttcccattt

SEQ ID NO: 117838 - DNA, 871 bp, Homo sapiens
  Payload ID: 3030
  Gene Symbol: C1orf146
  Gene Name: chromosome 1 open reading frame 146
  ENST ID: ENST00000370373
  CDS Start-End: 465-830
gaggacctggtgagcagattgttgcaccattagaagctaggttgatccacagacagatggctgaaagtggaaaagaaaaaataaaatggacaaccaccattattattagctcatctcttaagtagaaagaaggtctcgctacattgcccaggctgttctcaaactcctgggctgaagtgattctctcacctcagcctcccaaagtgctaggattacaggtgtgagccattgtgcctggccaagtttaaattttaacctatcaggaaaaactattaaccacctagattttagtattgtgggtaatatgatttaattgcctgggtggaataggaaatcaggtgatatttgaaatgagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataat

SEQ ID NO: 117839 - DNA, 830 bp, Homo sapiens
  Payload ID: 3030
  Gene Symbol: C1orf146
  Gene Name: chromosome 1 open reading frame 146
  Uniprot ID: Q5VVC0
  ENST ID: ENST00000370375
  CDS Start-End: 149-691
gccccaggcaccctgggcgctctgccctaccggcggcgcctctcactgctcacggaacgttctggaagtttgggaaaccctgagcggtctctgaggacctggtgagcagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttagga

SEQ ID NO: 117840 - DNA, 695 bp, Homo sapiens
  Payload ID: 3031
  Gene Symbol: C1orf158
  Gene Name: chromosome 1 open reading frame 158
  ENST ID: ENST00000376210
  CDS Start-End: 7-477
cttaacatgtttttgactgcagtaaatccacagccactctctactccgagctggcagattgagaccaagtattcaacgaaagtgctcactggaaattggatggaagagaggagaaaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctctcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacacta

SEQ ID NO: 117841 - DNA, 3549 bp, Homo sapiens
  Payload ID: 3031
  Gene Symbol: C1orf158
  Gene Name: chromosome 1 open reading frame 158
  Uniprot ID: Q8N1D5
  ENST ID: ENST00000614859
  CDS Start-End: 217-801
atccaagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctctcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactattgcagggctatgtacgtgcacaagacagattcagactgtcagagaaaacaggaagggcccttaagttctaccctgttgtttcacaagaggggaaactgaggcccggagaggtaatgtgacttgctgaagagtctactcccatggaggaaatgaatctgatgatgaaacccatcatgaaaactccacagaatgactgaatgtggttcccaggagggcagtgctgcagagctggcaatggggaaggaccccagcttgtctgtcattgccaaggcagaggaaggcgtgctctggccccacggggctcagaagaaggggaaaacacatggcatttcctttgtctctgagctcgcaaatctttgtgtttttttttttgtttttttttttgagacggagtgtcgctctcttgcccaggctggagtgccgtggcacgatctcagctcactgcaacctctgcctccagggttcaagcgattcttttgcctcagcctcctgagtagctgggactacaggtgcgcaccactacgcctggctaatttttgtatttttagtagagacagggtttcacaatgttggccaggctggtctcgaactcctgacctcgtgatccgcctgcctcggcctcccaaagtgctgggattagcaggcgtgagccaccgcacctggctgagctctcaaatctttatgagcctgggcagaggggagaacctctggtgagtgatttgggagagagggtggatctcctagcagaagaactcaggcatggtcctcgcccaggacaggggtccacaagtgtgcatgctcagtgctcgcacagagctgcctctttgaagaaattccagcagacacctttggccctttgcatgcttggctcatgggcacaggtgtgttttgtcagtgattttgtactgcacaccaataatatgactcccagtatgggagcctgagtctctgccattgttttcacaggatacctgctggcctcaggccacctaccttagggtcactttggcacctactaagttccttccttagtcatccaagtgtccatgtaaggacgctgtcttccatcccaactgaaagtcagagcctgacacaggctaagtcctctatgtttgttggatgagtgaatgacaggagttgaacaaatgagttgaatgaatgaatgacaggaggaggagccagggggtgcagaaaggttgcacctaccttagggtcactttggcacctactaagttccttccttagtcatccaagtgtccatgtaaggacgctgtcttccatcccaactgaaagtcagagcctgacacaggctaagtcctctatgtttgttggatgagtggatgacaggagttgaacaaatgagttgaatgaatgaatgacaggaggaggagccagggggtgcagaaaggttgctgcaggagacagctgtgggatggagtggagctggctgtcctcacacctccaacatccagcctttctattgagcatccattgagccatgtctgggccaggccctgacctcacagagcctcagtccagcagtcagggaggagcatgaggtaaatggctgcaggacagagaggtgctgcagctggaggccctgggggacagcgatggattgcgaggagtgagggagacccaggatatgctaagcaggggcgtctaatcttttggcttccctgggctacattggaagaagaattgtcttgggccacacataaaaaaatgaacaggggctgggcgcagtggctcatgcctgtaattccagcactttgggaggcctatatgggcggatcacctgaggtcaggagtttgtgactagcctgtctagcacagtgaaacactgtctctattaaaaatacaaaaatgagctggcatagtggttcatgcctggaatcccagctactccagaggctgaggcagcagaatcgcttgaacccaggaggcggaggtttcagtgagaccagatggtaccactgcactccagccttggtgacagagtgagactccatcccaaaaacaacaacaacaacaacaaacttacactaacggtagctgatgagctaaaaaaaaaatcgcgtaaaaaaaccccataatgttttaagtaagtttacaaatttatgttgggccacattcagcctgcaggcggagggttggacaagcttgtgcgaaagtaaaggatgtcatgagagcaacgggcaggggttgacggatgatgaatgaagacctggcctgcctaggtagggccagggagaatcaggtaggtcaaggccagaaagctgagggagattacccagctgaagggacaggttgggagggaagagagggtggcttgggccatgggggcaacacgtttgaagtctctgacttgggaagaagctgagcaaattccttaaaagtccagaaagaccatgcattggtctcctattgctgctggaacaaaataccacaaactcagtgccctaaagcaacacatgtttatttgacagttcttattataaatgtgaataaatgcacatttattcagaa

SEQ ID NO: 117842 - DNA, 1097 bp, Homo sapiens
  Payload ID: 3032
  Gene Symbol: C1orf159
  Gene Name: chromosome 1 open reading frame 159
  Uniprot ID: Q96HA4
  ENST ID: ENST00000379319
  CDS Start-End: 308-904
ggtagagggatcaagttgtcttcaattttatctcctctgctgactttttagttctgcctctttgtgttgttttttaagtggttcctctggagattaaatgtacttcacagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccacca

SEQ ID NO: 117843 - DNA, 2324 bp, Homo sapiens
  Payload ID: 3032
  Gene Symbol: C1orf159
  Gene Name: chromosome 1 open reading frame 159
  ENST ID: ENST00000379320
  CDS Start-End: 632-1666
gcaccgtaggccacggcccacctgggttgccctcgcgtgaccacggcctcacctgctgtcttcatctgcaggactgggccggggtctgcagggctcagctgagcccatgagctcccagagctaacccctgaacacccaggcgggcaaagggctgatgtcggtagtccccatcctggaggggcaggtaaggccctgcctacacctcgccccacccgtgcctccaaaggccccaagccttcactctttcaccccacctccatttggctccaccttccctgtcgtggccctgcacccctgccacggccctgccccatctccatttaactcagtcatctgccgcggccccgccccaccccatctccatttggccccaccctccctgccacagccccgcccacttccatttggccccaccctccaccacagccccgcccacttccatttggccccaccctccaccacagccccacccatctccatttggctctgccctccttgccttggcccgcacccccccaacatctcttgaccccactttcatttggccccacccaccctgcctcagccccactccatctctttggctccgcatgctcctccctgtggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaa

SEQ ID NO: 117844 - DNA, 2010 bp, Homo sapiens
  Payload ID: 3032
  Gene Symbol: C1orf159
  Gene Name: chromosome 1 open reading frame 159
  Uniprot ID: Q96HA4
  ENST ID: ENST00000379325
  CDS Start-End: 172-741
cggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaa

SEQ ID NO: 117845 - DNA, 2429 bp, Homo sapiens
  Payload ID: 3032
  Gene Symbol: C1orf159
  Gene Name: chromosome 1 open reading frame 159
  Uniprot ID: Q96HA4
  ENST ID: ENST00000379339
  CDS Start-End: 212-1354
gagaaacccggagggcgccgggtattaccagggtgtgcagagaaggcagagctgcgtcttcctcttttatttttccgactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggtcacgagaaacagcacagctgtgatcaacacacaagctgagggtaccctgagccccccaggcctgtccagtctgcctgtggtcagggaatgggccctcacacacaccgcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 117846 - DNA, 842 bp, Homo sapiens
  Payload ID: 3032
  Gene Symbol: C1orf159
  Gene Name: chromosome 1 open reading frame 159
  ENST ID: ENST00000434641
  CDS Start-End: 172-842
cggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccggggg

SEQ ID NO: 117847 - DNA, 575 bp, Homo sapiens
  Payload ID: 3032
  Gene Symbol: C1orf159
  Gene Name: chromosome 1 open reading frame 159
  ENST ID: ENST00000427787
  CDS Start-End: 384-575
gagtcctccggcaggctcacacctgggcagcctggtcagtttgtgaggccatgacctgaatccagcatggaatgggtgacagagtggaccgtccctgtgcggagagtggaccgtccctgtgcagagactggagctgtgtcctccagggcctccgtctccctgctgctcacagcccttgtcccaggaccccggcctaggcccatcaagaggagccccacaggcctggctgggcctcagcccccctcggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggacactgatgtcccagccccagaggtgctgaccaggtccactgctggggtcagaggggcctgtgcctcgcagaggggagccctccgctgcctgctgggcccagctgcccgagtgctgtgt

SEQ ID NO: 117848 - DNA, 1841 bp, Homo sapiens
  Payload ID: 3032
  Gene Symbol: C1orf159
  Gene Name: chromosome 1 open reading frame 159
  Uniprot ID: Q96HA4
  ENST ID: ENST00000421241
  CDS Start-End: 175-771
gggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaa

SEQ ID NO: 117849 - DNA, 554 bp, Homo sapiens
  Payload ID: 3032
  Gene Symbol: C1orf159
  Gene Name: chromosome 1 open reading frame 159
  ENST ID: ENST00000442117
  CDS Start-End: 384-554
gagtcctccggcaggctcacacctgggcagcctggtcagtttgtgaggccatgacctgaatccagcatggaatgggtgacagagtggaccgtccctgtgcggagagtggaccgtccctgtgcagagactggagctgtgtcctccagggcctccgtctccctgctgctcacagcccttgtcccaggaccccggcctaggcccatcaagaggagccccacaggcctggctgggcctcagcccccctcggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcg

SEQ ID NO: 117850 - DNA, 740 bp, Homo sapiens
  Payload ID: 3032
  Gene Symbol: C1orf159
  Gene Name: chromosome 1 open reading frame 159
  ENST ID: ENST00000475119
  CDS Start-End: 482-740
gcgaggaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcagccccactccatctctttggctccgcatgctcctccctgtggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtg

SEQ ID NO: 117851 - DNA, 3214 bp, Homo sapiens
  Payload ID: 3032
  Gene Symbol: C1orf159
  Gene Name: chromosome 1 open reading frame 159
  ENST ID: ENST00000477196
  CDS Start-End: 166-462
gtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggacactgatgtcccagccccagaggtgctgaccaggtccactgctggggtcagaggggcctgtgcctcgcagaggggagccctccgctgcctgctgggtgagcgcctgctcaggaatggctgggtcaggcggggcccccacggtgaggcatcctggcccgcaatgggagcacctctgccagcggtgacagcacagcgtgccgcgcatcgctatcggggagtgtagctgcggcggctccagactcccaggcggagcgggtggagggtggggacccctcactgtcctggctggggcgtttgagggaccggacctgggcccctccctggcggtgtggattctatcccgcactccgcagtcacccctggacgccctcaccgttcactgcattcaggtcacgagaaacagcacagctgtgatcaacacacaagctgagggtaccctgagccccccaggcctgtccagtctgcctgtggtcagggaatgggccctcacacacaccgtaagtgccagcacccagcgcacctgtgcagtacctgggcacctgggcgtgaattcgtcccctgaaatgccagccaggcccgggcacttcctctgtggggtcaagcggaaacccctgatggagagcctccggagacttgcagagaatgtcggtggcgctgccatggcctgcgggtgccgcctcctgggggtggtttactcttccaggcccagcttttccttggagaccgcccacccagggtcccacagggatgtgcactgtggctgtgaggcccctccttgctcccaggcccacaggggacagagggccacccgatgctgactccagaagaggccggagctgcggacattgagatgtgctcccacggcacccctcagccgctgctgctctgggcgtgagcctgcctggcaggcgcgtcctggagtttcactgccgtgtcccctccaggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactc

SEQ ID NO: 117852 - DNA, 2099 bp, Homo sapiens
  Payload ID: 3032
  Gene Symbol: C1orf159
  Gene Name: chromosome 1 open reading frame 159
  ENST ID: ENST00000467751
  CDS Start-End: 166-501
gtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggacactgatgtcccagccccagaggtgctgaccaggtccactgctggggtcagaggggcctgtgcctcgcagaggggagccctccgctgcctgctgggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactc

SEQ ID NO: 117853 - DNA, 836 bp, Homo sapiens
  Payload ID: 3032
  Gene Symbol: C1orf159
  Gene Name: chromosome 1 open reading frame 159
  ENST ID: ENST00000462097
  CDS Start-End: 527-836
gaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccgggtggttcctctggagattaaatgtacttcacagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctg

SEQ ID NO: 117854 - DNA, 579 bp, Homo sapiens
  Payload ID: 3032
  Gene Symbol: C1orf159
  Gene Name: chromosome 1 open reading frame 159
  ENST ID: ENST00000480643
  CDS Start-End: 536-579
gtacgaaagagaaacccggagggcgccgggtattaccagggtgtgcagagaaggcagagctgcgtcttcctcttttatttttccgtgctctgagtgcggggcccgccgagcctgcacccacccagaactcacgctgcatgcagccccggttcccgcctgcagctctccctccacacctccctgcaagcagagggagccggctccggcctcggccagcccagagaggggctcccacagtgcagcggtgggctggagggctcctcaagtgtggccagcgtggatgctgaggcccaggaggtgctgagatggttcctctggagattaaatgtacttcacagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtggg

SEQ ID NO: 117855 - DNA, 1107 bp, Homo sapiens
  Payload ID: 3033
  Gene Symbol: C1orf162
  Gene Name: chromosome 1 open reading frame 162
  Uniprot ID: Q8NEQ5
  ENST ID: ENST00000343534
  CDS Start-End: 251-718
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcgaagggagaggcttcccatttccccaggcccattgctgagatgggtccctcttctttctggcaccatggcagatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccaca

SEQ ID NO: 117856 - DNA, 915 bp, Homo sapiens
  Payload ID: 3033
  Gene Symbol: C1orf162
  Gene Name: chromosome 1 open reading frame 162
  Uniprot ID: Q8NEQ5
  ENST ID: ENST00000369718
  CDS Start-End: 174-566
gagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaa

SEQ ID NO: 117857 - DNA, 2624 bp, Homo sapiens
  Payload ID: 3034
  Gene Symbol: C1orf167
  Gene Name: chromosome 1 open reading frame 167
  ENST ID: ENST00000312793
  CDS Start-End: 1-2485
ggagagggagactctgcggaaggccaccagggccacacagaggacagggagcttcccccaggcctggcactctactgctgcaggtgtagcctgggtggccccactgagcccccagcaccagagagcttggctgtgcaggtgcttcggggcgtggcagcagttcgtgcaaagagggtcccggtaccgagaccacctggctgaccgccggacggggaccctgaggaaatgcctggaacagtgggtgcggatgaagcagctccgggaatcagatggggcaaaggtgacccagctgtccctctgccggcagaaagcaggacgtgaggctgtctacaccgcaggccctggagcctgtggcctgggtgcagtgggccaggcccaggggcagcaggagcaaggccggggctccctgcaggatgcctgctggacactggccctctgctgggcgctgctgctgtggaagatgcggcttttccagcgccagtgggccaactccttcttccagggcctgcagcagcggatgctgcagcgcagcctgagatggtggcacttgagggcactgggcccagatgccacatcaagctgcaccaagaccccctcggctctggagccactgagcagcagcacactccaagactctctggagaaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtccta

SEQ ID NO: 117858 - DNA, 1881 bp, Homo sapiens
  Payload ID: 3034
  Gene Symbol: C1orf167
  Gene Name: chromosome 1 open reading frame 167
  ENST ID: ENST00000444493
  CDS Start-End: 1-1849
cagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacgtgctcgttcctgcaggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaa

SEQ ID NO: 117859 - DNA, 1617 bp, Homo sapiens
  Payload ID: 3034
  Gene Symbol: C1orf167
  Gene Name: chromosome 1 open reading frame 167
  ENST ID: ENST00000449278
  CDS Start-End: 1-1598
gagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaa

SEQ ID NO: 117860 - DNA, 4545 bp, Homo sapiens
  Payload ID: 3034
  Gene Symbol: C1orf167
  Gene Name: chromosome 1 open reading frame 167
  Uniprot ID: Q5SNV9
  ENST ID: ENST00000433342
  CDS Start-End: 1-4407
atgacccggatgtcctgcccctggggttcctaccagtgggagccgggggcatgtcctgcagccccaagaggcataggtggtggggacatggctgggggtatcccagatgtgcgggggctccaggaggcagctctaggtgcgggaaggagccaagaggaggcacgcctggtggaggaagcccagaccccagtgatgctgccacaggattcggggcagagggtggaggaggttcccggggacctgatggccaagagaatgtcgctcatcttgcacgtgcaaaagttgccctgggaccacgtgccttgcctgcggaggacccggcaaaacctgtaccaggacgtcggtggccacgcccacggctcagggctgggcggggccaagcgcggggcagcacgctctgctctccgacgtcccctcccgcccgcgacctgccgacctgcggggatcgttagcggtcccagcccccgtctagattcaaatccgactggggcccatctgattaaacagaccaggccactcactgtggagtggaccaaggatactcctgtccctgagcccatggagctaaggtctgatgccagccacaaggagaatgtgtccccaaagcctgcagcgctcccgaagccaggcaagaggcttaagcaacgaagattccggaggagcctgggcatcggcctgagtggtagacatgaccagtgggtgcccgggtgccaggtggagaggggagggcctgctgccacaccctccccaggggcagtgctagaccaggagccctgccgagtccagaccaacctggccagccctggtccccgcctgggcctagctctgaaggacacgactggccaactggtcaattcaagcttctggcaacagagcaacctgcagtccctggccaggaggcgccaagggaaggcccgagagtttgccatccagcagagcaacctgagcatcaacgagaccagcagcccccacctctgcccagagcctgggggaagctctgggccccacaagcttccctggggtcctctcctatcccaagagccactggctcgcccatcttcctgcctgaggcagtccgggctgccggccccaggcacccctagcggggacttcaggcccactgaagcctttgcccctctcgatgggcatacacagccaggcctcagatcctggggtggtctggggagctggaggtccaggctggtgggggaacctctcaccctggaggacctggctgtccccagtcagaaccagactcaggccccatcccgtgctgccgtccaccagctgctggcttctgtacattgcctggcgcaggaggcagcccgactcaggtgccaggctccccaggaaccccccgcctggggagtctcacccaagcagaaaggagaggagggggccccgagggagcgggtccacagggaggaggagaggacagctttccatctgtcagacacagtcccagcgagcagtgcgtcgaagaacaaggcacaaaacatcacagccccagagtctgaggcaatctgctggcagctgttgtccagatgttttcgatcctggaggcacttggtgaagaggcagcgggagccagcggcggcggcagtggcactgggccgctggcagctgttgcgaaagtgccttcaggccttgtggctccgggaggctcagctggaggcagcatgggggcagtacacaaaggttctgctggtccggagcttccgagaggtcagcggtctccaggttgggccagggggccgtgtgaagcagtgtccaggaagtctgagggaggaggagattgctcagcggcttctgtcacatcctaggcagagaacagacagcagacacgagagagtccagatcctgcaggccctgcaactggctgtgttcttcctgtggtgccaacagaagaaacgggccagacaggagagggagactctgcggaaggccaccagggccacacagaggacagggagcttcccccaggcctggcactctactgctgcaggtgtagcctgggtggccccactgagcccccagcaccagagagcttggctgtgcaggtgcttcggggcgtggcagcagttcgtgcaaagagggtcccggtaccgagaccacctggctgaccgccggacggggaccctgaggaaatgcctggaacagtgggtgcggatgaagcagctccgggaatcagatggggcaaaggtgacccagctgtccctctgccggcagaaagcaggacgtgaggctgtctacaccgcaggccctggagcctgtggcctgggtgcagtgggccaggcccaggggcagcaggagcaaggccggggctccctgcaggatgcctgctggacactggccctctgctgggcgctgctgctgtggaagatgcggcttttccagcgccagtgggccaactccttcttccagggcctgcagcagcggatgctgcagcgcagcctgagatggtggcacttgagggcactgggcccagatgccacatcaagctgcaccaagaccccctcggctctggagccactgagcagcagcacactccaagactctctggagaaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcct

SEQ ID NO: 117861 - DNA, 3135 bp, Homo sapiens
  Payload ID: 3035
  Gene Symbol: C1orf168
  Gene Name: chromosome 1 open reading frame 168
  Uniprot ID: Q5VWT5
  ENST ID: ENST00000343433
  CDS Start-End: 82-2268
agaggaaagcggattgttggccccaggacccagctctgagaggctgggcttgtttccctgactctgccttggaggaaagcaatggaaggggaaggggtaagaaacttcaaggaacttcgagccaaatttcaaaatcttgatgctccacctcttccaggacctattaaattcccagcaggtgtttctccaaagggtgacattggaggcacacagtcaactcaaattttggccaatgggaaacccctctcatccaaccacaagcagcgcacaccatactgttccagtagtgagtcccagcctcttcaacctcagaaaataaagttggctcagaagagtgaaattccaaaatgttctaactccccagggcctctgggaaagtctactgtatgttctgcaacaagttcacagaaggcttctctgctgttagaggtgactcaatcaaatgttgagataatcactaaggaaaaagtaatggtggccaatagcttcagaaacaaactctggaactgggagaaggtttcatctcagaaaagtgaaatgtcttcagcccttctccttgccaactatggaagtaaggccatccatctggaagggcaaaaaggcatggggcttactccagaggaacccaggaaaaagctggaaacaaaaggagcccagactcttccttcccagaagcacgtggtggcccccaaaatattacataacgtctctgaagatccctcttttgtaatttctcaacatatcagaaaaagctgggaaaacccacctcctgagaggagcccggcaagcagcccctgccagcccatctatgagtgtgagcttgccagtcaggccccagaaaaacagccagatgtcaggcatcaccaccttcccaaaacaaagccattgccctccatcgactccctgggtcctcctcccccaaagccttcaagacctcccatcgtgaacctccaggcctttcagaggcagccagctgctgttcccaagactcagggggaagtgactgtggaagagggctccctgtctccagagaggcttttcaatgcagaatttgaagaaccacataattacgaggcaacaatttcatatctgagacactctggcaactccattaacctgtgcactgcaaaagaaattgctgatccaacttatgaagttggaattgaagaactccaaaagcctgggaagaattttccctatccagaacctagtgctaaacatgaagataaaaaaatgaaggaaaaacaaccatgtgaattgaaacctaaaaacacagaaaaggaaccatattcaaaccatgttttcaaggtagatgcctgtgaagggacacctgaaaaaattcagatgaccaacgtccacacaggtagaaggaacatgttggctggaaagcaagaggccatgattgacatcatccagacaaatccctgccctgagggcccaaagctggccaggcactcccaaggccactgtgggcatctggaggttttggagtcaactaaagaaactccagacctaggggtctctaagacaagttccatctcggaggagatatatgatgatgtcgagtactccaggaaagaggtaccgaagctgaactactctagctcacttgcctcaagtagtgaagaaaatagagaactgtatgaagatgtctacaaaacaaagaacaactacccaaagatagatttagatggaaaagaagcactcaaaagactgcagcaattcttcaagaaagaaaaggatagatttaaaataaagaaaaccaagtcgaaagaaaacttaagtgcattttccattttgctgcctgatttagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacagaatgaaaagagaagaaaaactatttagagaaaggtttaagtacgacaaagagattattgtcatcaatacagcagtggcctgttccaataattcaagaaatggaatatttgatttgccaataagtcctggagaagaattggaagtcattgataccaccgaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctgacatctattctgttttttaaatgaggtgcactgcatgtcaataagagaaataaattctacatatgca

SEQ ID NO: 117862 - DNA, 1666 bp, Homo sapiens
  Payload ID: 3036
  Gene Symbol: C1orf174
  Gene Name: chromosome 1 open reading frame 174
  Uniprot ID: Q8IYL3
  ENST ID: ENST00000361605
  CDS Start-End: 100-831
gtcggacgccgccgcggcgcgctctgcagactccgggtcgccgctccgccgggacgcgttggccggggcgcgcggtgcttggctgcggtgctcacactcatgaggagccggaagctcacaggtgcagtgcggtcttcagcgcgcttgaaagcacgaagttgttcggcagccaggttggcctctgcccaggaagttgctggttccacgtctgccaagacagcatgtctgacttcctcatcccacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtggaggatgtactcatgggaactaaaactcaaaccatctttgaggttgcaaagctgctgtactgtgccaatgtcctttctttttttttttttttttttttccttggagacagagtttctctcttgtcgcccaggctggagtgcaatggcgcaatctcggctcactgcaacctccacctcctgggttcaagtgattctcctgcctcagcctcctgagtagctgggattacaggcatacaccaccacacccagctagtttttgtattattagtagacacgggggtttctccacgttggccaggctggtctcaaactcctgacctcgtgatacgcccgcctcagcctcccaaagtgctgggattacaggcgcgagccaccatgcccggccagtgtcctttcttatacacgtacatacatgatgatggcttgagtcagctgcagggcagtgggcttaatgagagggatctttgtaaagacagctcttcacttcagctcagtagctttggtcataggcaagtttgttttccattatcataatttgatgattcttgtgatgaattcaatgctagttcttaaagaactcttttatttctgtatgtggagctaatgtttaccttggaaattttgcaaaatacatgtaagaaagaaataaaatatattttgaaaatattttgaaa

SEQ ID NO: 117863 - DNA, 915 bp, Homo sapiens
  Payload ID: 3037
  Gene Symbol: C1orf185
  Gene Name: chromosome 1 open reading frame 185
  Uniprot ID: Q5T7R7
  ENST ID: ENST00000371759
  CDS Start-End: 1-600
atggcttcacctaaaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacataatactgaatgacttttttcttttgaaaccttgtatacaatcagcttctgagtctcttaacatgtccatgctaatattgctttttttgttctttaccatagagcggctctacttcccttgctggttcttatttctagaaacaaaattaggaagaactagagtgatgtcatgaacattaagcttaacttattgtatctcatccaaagacatattaaataaaatgagtgtatgtcaacaaa

SEQ ID NO: 117864 - DNA, 747 bp, Homo sapiens
  Payload ID: 3037
  Gene Symbol: C1orf185
  Gene Name: chromosome 1 open reading frame 185
  ENST ID: ENST00000467127
  CDS Start-End: 257-673
agtctagctttttgcctgggaagaagaggaaaatatatttagacgaacaaccagaaatctatttctattctctggaagagcttgtataagtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaac

SEQ ID NO: 117865 - DNA, 899 bp, Homo sapiens
  Payload ID: 3037
  Gene Symbol: C1orf185
  Gene Name: chromosome 1 open reading frame 185
  ENST ID: ENST00000612209
  CDS Start-End: 1-588
ataggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacataatactgaatgacttttttcttttgaaaccttgtatacaatcagcttctgagtctcttaacatgtccatgctaatattgctttttttgttctttaccatagagcggctctacttcccttgctggttcttatttctagaaacaaaattaggaagaactagagtgatgtcatgaacattaagcttaacttattgtatctcatccaaagacatattaaataaaatgagtgtatgtcaa

SEQ ID NO: 117866 - DNA, 1665 bp, Homo sapiens
  Payload ID: 3038
  Gene Symbol: C1orf186
  Gene Name: chromosome 1 open reading frame 186
  Uniprot ID: Q6ZWK4
  ENST ID: ENST00000331555
  CDS Start-End: 640-1158
attgtatagaagaacattgtgaaactccctgccctgttctgtttctctctgaccaccggtgcatgcagcccctgtcacataccgcctgcttgctcaaatcaatcatgaccctttcatgtgaaatctttagtattgtgagcccttaaaagggacggaaattgtgcattcggggagctcggattttaaggcagtagcctgctgatgctcccagctgaataaagcccttccttctacaatttggtgtctgaggggttttgtctgcggctcgtcctgctacatttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctctatggattcttacatttaatttgtagggaaatgccatttttcccccttaaacaaggcatggggctcacaagtctatggagacaggccaaaaagaatgtggagaagaaaactgataaatacacagaggtcctcaagacccatggactcctggtctgtacccaaaaaagctgttcgttcctcaaaaacaaaaacaaggcttggctgggaaaacaggccaatgccccggcaagaaaggttgagatcagatgttaggaagaactttcaggtaaagtatgagaactatggagtccatcagcagagatagtagtgaagtctctccccagggaaaattttaaaaaggttgaatcagctgttgtagagttctatttggcaatctcatggttaaatgacttccctttgagctctttaattattggcaataaacaacttctttaaaagttttaaataaaatagcaaccaccaccagttcctcttt

SEQ ID NO: 117867 - DNA, 1145 bp, Homo sapiens
  Payload ID: 3038
  Gene Symbol: C1orf186
  Gene Name: chromosome 1 open reading frame 186
  Uniprot ID: Q6ZWK4
  ENST ID: ENST00000582070
  CDS Start-End: 131-649
cctggagtcctgaccagctccttacctcttgcagatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctctatggattcttacatttaatttgtagggaaatgccatttttcccccttaaacaaggcatggggctcacaagtctatggagacaggccaaaaagaatgtggagaagaaaactgataaatacacagaggtcctcaagacccatggactcctggtctgtacccaaaaaagctgttcgttcctcaaaaacaaaaacaaggcttggctgggaaaacaggccaatgccccggcaagaaaggttgagatcagatgttaggaagaactttcaggtaaagtatgagaactatggagtccatcagcagagatagtagtgaagtctctccccagggaaaattttaaaaaggttgaatcagctgttgtagagttctatttggcaatctcatggttaaatgacttccctttgagctctttaattattggcaataaacaacttctttaaaagttttaaataaaatagcaaccaccacc

SEQ ID NO: 117868 - DNA, 614 bp, Homo sapiens
  Payload ID: 3038
  Gene Symbol: C1orf186
  Gene Name: chromosome 1 open reading frame 186
  ENST ID: ENST00000603378
  CDS Start-End: 185-559
taggggctggagaagggtcggggagatatttccgttaggacatcgctgaaacacagactgggatcaaactgtgctcatagtcctaaggatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctctatggattcttacatttaatttg

SEQ ID NO: 117869 - DNA, 727 bp, Homo sapiens
  Payload ID: 3038
  Gene Symbol: C1orf186
  Gene Name: chromosome 1 open reading frame 186
  Uniprot ID: Q6ZWK4
  ENST ID: ENST00000603488
  CDS Start-End: 177-695
ggagaagggtcggggagatatttccgttaggacatcgctgaaacacagactgggatcaaactgtgctcatagtcctaaggatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctc

SEQ ID NO: 117870 - DNA, 387 bp, Homo sapiens
  Payload ID: 3039
  Gene Symbol: C1orf189
  Gene Name: chromosome 1 open reading frame 189
  Uniprot ID: Q5VU69
  ENST ID: ENST00000368525
  CDS Start-End: 27-332
agactgtatcaagcaaatctatagacatgtctgtggaaaagatgacaaaagtagaagagagttttcaaaaggccatgggacttaagaagacggtcgacaggtggcgaaattcacatactcactgtctgtggcaaatggcattgggccagagaagaaacccgtatgccaccctaaggatgcaggacaccatggtacaggaattggcactggccaaaaagcaactactaatggtccgtcaagctgccctgcaccagctgtttgaaaaggagcatcagcagtaccagcaggaactaaatcagatgggcaaagctttttatgtagagagattctgatggcatccaaaacactgctcttccattctcaacatgcctgctaacctagccttct

SEQ ID NO: 117871 - DNA, 534 bp, Homo sapiens
  Payload ID: 3040
  Gene Symbol: C1orf194
  Gene Name: chromosome 1 open reading frame 194
  ENST ID: ENST00000369945
  CDS Start-End: 69-461
atgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaaga

SEQ ID NO: 117872 - DNA, 663 bp, Homo sapiens
  Payload ID: 3040
  Gene Symbol: C1orf194
  Gene Name: chromosome 1 open reading frame 194
  Uniprot ID: Q5T5A4
  ENST ID: ENST00000369948
  CDS Start-End: 77-586
gggatcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaa

SEQ ID NO: 117873 - DNA, 731 bp, Homo sapiens
  Payload ID: 3040
  Gene Symbol: C1orf194
  Gene Name: chromosome 1 open reading frame 194
  Uniprot ID: Q5T5A4
  ENST ID: ENST00000369949
  CDS Start-End: 181-654
gcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaa

SEQ ID NO: 117874 - DNA, 485 bp, Homo sapiens
  Payload ID: 3040
  Gene Symbol: C1orf194
  Gene Name: chromosome 1 open reading frame 194
  ENST ID: ENST00000462402
  CDS Start-End: 168-278
gcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaa

SEQ ID NO: 117875 - DNA, 418 bp, Homo sapiens
  Payload ID: 3040
  Gene Symbol: C1orf194
  Gene Name: chromosome 1 open reading frame 194
  ENST ID: ENST00000460065
  CDS Start-End: 69-215
atgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaaga

SEQ ID NO: 117876 - DNA, 3858 bp, Homo sapiens
  Payload ID: 3041
  Gene Symbol: C1orf198
  Gene Name: chromosome 1 open reading frame 198
  Uniprot ID: Q9H425
  ENST ID: ENST00000366663
  CDS Start-End: 142-1125
tgggttggcttggagacccgggtacgcggcggtgcagggcggggttcccggagggggcggggctccgggtggcgcggggcggggcgagggcgggcacagcgaggggcggggcgcgggccgggagcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 117877 - DNA, 3666 bp, Homo sapiens
  Payload ID: 3041
  Gene Symbol: C1orf198
  Gene Name: chromosome 1 open reading frame 198
  ENST ID: ENST00000427697
  CDS Start-End: 602-934
tttggtttgtttgcaaacgtcgaactgccaagagttctgagctccttgggttggggaaaggcacctgggccaccgggtacttcatgcacccacctggccccgaggggcggcgggagctgactttccttgagcaccagatgccccgaaccggtccagccttccaggtcgccctccagcctccgggctgccctgcgcccccggctatctgcagctcaccgcgccaggccccgggcccagcgtcctggacgggcccagagaaagcagagaagtggccacgtggcgctatggcggtcactaccgggaattaaccacggccaccctctcagagcgccgggcgcggactcagggacacgccggctaccacctgagccgggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgct

SEQ ID NO: 117878 - DNA, 3819 bp, Homo sapiens
  Payload ID: 3041
  Gene Symbol: C1orf198
  Gene Name: chromosome 1 open reading frame 198
  Uniprot ID: Q9H425
  ENST ID: ENST00000470540
  CDS Start-End: 217-1086
ttttgtgttcagaactatccaggcaaagaccctggataacagctgaaatgctggtttttgtttttgtttttttattttacgagtggacacaattctcacctgagtccttggccacgtggcgctatggcggtcactaccgggaattaaccacggccaccctctcagagcgccgggcgcggactcagggacacgccggctaccacctgagccggccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 117879 - DNA, 675 bp, Homo sapiens
  Payload ID: 3041
  Gene Symbol: C1orf198
  Gene Name: chromosome 1 open reading frame 198
  ENST ID: ENST00000522201
  CDS Start-End: 195-675
ccaggcagccagcggcttggcctgaaatgctggggctttcttaggctcactggaggttgaaaaaagtttcctttgtcaagcagtggccacgtggcgctatggcggtcactaccgggaattaaccacggccaccctctcagagcgccgggcgcggactcagggacacgccggctaccacctgagccgggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctg

SEQ ID NO: 117880 - DNA, 1041 bp, Homo sapiens
  Payload ID: 3041
  Gene Symbol: C1orf198
  Gene Name: chromosome 1 open reading frame 198
  Uniprot ID: Q9H425
  ENST ID: ENST00000523410
  CDS Start-End: 217-810
attctgctgagaccatcaagccctcatccactcctactcatctcatctgtctgagtccattggggggcctcaccggcattccctgttgtctgtttggctggggaggggagtgtctggcagcctcagcgggaaagatgagggagcaatctgatcaagacggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaattttt

SEQ ID NO: 117881 - DNA, 2501 bp, Homo sapiens
  Payload ID: 3042
  Gene Symbol: C1orf204
  Gene Name: chromosome 1 open reading frame 204
  Uniprot ID: Q5VU13
  ENST ID: ENST00000368102
  CDS Start-End: 111-818
gaaaagcaccttcttctgggcctgcgaaacatcagaaagggattgcaggggcctggagggggctgcctgcagggctctccagatacgcgtggacaagccctgtctggaggatggggatgctggctccgggaccgctgcagggtcgccgacccaggaagggtcacaaaggacaagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgctgtt

SEQ ID NO: 117882 - DNA, 708 bp, Homo sapiens
  Payload ID: 3042
  Gene Symbol: C1orf204
  Gene Name: chromosome 1 open reading frame 204
  Uniprot ID: Q5VU13
  ENST ID: ENST00000621242
  CDS Start-End: 1-708
atggggatgctggctccgggaccgctgcagggtcgccgacccaggaagggtcacaaaggacaagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatga

SEQ ID NO: 117883 - DNA, 10265 bp, Homo sapiens
  Payload ID: 3043
  Gene Symbol: C1orf21
  Gene Name: chromosome 1 open reading frame 21
  Uniprot ID: Q9H246
  ENST ID: ENST00000235307
  CDS Start-End: 436-801
cccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactgctaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgtttgtactttatttttttgtgccttctgaaaggatctaaaacaaaaatattttgcctttttttccccacgtgtatctgaacattaagcagattggctcagacacaatgaaaaggataatccaatgtacgtgctggtgcactctgctagttgttatctctgtagggctcaggaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtctatgaattgccttttgccaatgaatggatgtatttttccaaggggggaatagtatccttgactttggcagtcacctttttgtatgtctctagaaaggggtcaaaaaactatggtaaagatgaggcttatgagtgaatacctctgggacaaaccttaggactcacaagctatgccatgtttttcaggagactcttgtaccttatctggaatctaatcttgggagaagaggaaaaaggagctaatatttgtcatttatactcactctgtgccagatactgtgctaggcattttataattgttttgtgtcatcctcatgataatcctgtgaagtagatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccaggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgcccactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttaggcttgttcatggaatataagccaagtttacctctccccattttctgccctggcccacttcccactcacctccacctcattgccaggaagggatcaaaatgcctccatgccagttgttaatggctacatatttgcccttcccaagggtatttgcattttatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaagggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaagagttg

SEQ ID NO: 117884 - DNA, 629 bp, Homo sapiens
  Payload ID: 3044
  Gene Symbol: C1orf210
  Gene Name: chromosome 1 open reading frame 210
  Uniprot ID: Q8IVY1
  ENST ID: ENST00000423420
  CDS Start-End: 164-505
acctgtccaggttctgccggccccagccggaagcttactccgcggattgtgcacagttcttgaaggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccacctctgccgccgataccatgccagctaccggcaccgcccactgcctgagacaggaaggggaggccgcccacaggtggctgaagatgaggatgatgatggcttcatcgaggacaattacattcagcctgggactggcgagctggggacagagggtagcagggaccacttctccctctgagctcccatctttagaccctccccactccctccatgcctgacagcttaaggacagtggttatgacatgggggccttgaacctcagggacagaggtggctggggcttaaaggttggccagggatgg

SEQ ID NO: 117885 - DNA, 1478 bp, Homo sapiens
  Payload ID: 3044
  Gene Symbol: C1orf210
  Gene Name: chromosome 1 open reading frame 210
  Uniprot ID: Q8IVY1
  ENST ID: ENST00000523677
  CDS Start-End: 235-576
tccgcggattgtgcacagttcttgaaggtgggaacagaagagaaggcccgggggggccggggagggggtacccaggctctgcacagtacccaaggggcttctggcagcaggaaggaagctacacatcagagttggggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccacctctgccgccgataccatgccagctaccggcaccgcccactgcctgagacaggaaggggaggccgcccacaggtggctgaagatgaggatgatgatggcttcatcgaggacaattacattcagcctgggactggcgagctggggacagagggtagcagggaccacttctccctctgagctcccatctttagaccctccccactccctccatgcctgacagcttaaggacagtggttatgacatgggggccttgaacctcagggacagaggtggctggggcttaaaggttggccagggatggagtaaaccccacttccctgacactagccagcaaagtgacaatgaccctctcttgctcaataactctcaactgttccctgctgttctcaggataaagccaaacaaaggcttgagtgtggacataaggccctctgtgatcatgcctctcggcctcttggtttcttttcttgccttcccctactttactgtcgaaatcaatgttattctccctcccaccacttcccatgcagtttccccaggcacctttgctcacattggtccccctgcctacgctactcttctcctaaatcctctatgactgtgatggcctgcctacctgccagcatttcaaatatgcccagatggtaacatttgtgcaggtgaaaaccagtgccaagcttcctttttttttttttcctgagacggagtctcactctgttgcccaggctggagtgcaatggcacatcttggctcactgcaacctccgcctcctgggttcaagcgattctcctgcttcagcctcctgagtagctgggattacaggcatccgccaccacgcccagctaatttttatatttttagtagagacgaggtttcgccatattggccaggatggtctcgaactcttgacctcaggtagtccgccttcctcggcctcccaaagtgctgggattacaggcgtgagccaccatgcccggccagcttcttaatgaaatattttcctataaataaagtgggtaatccggttataatatgtttttcacaggaattaataaatctattttcattttgaataaaaa

SEQ ID NO: 117886 - DNA, 3218 bp, Homo sapiens
  Payload ID: 3045
  Gene Symbol: C1orf216
  Gene Name: chromosome 1 open reading frame 216
  Uniprot ID: Q8TAB5
  ENST ID: ENST00000270815
  CDS Start-End: 772-1461
actttagtcaagtaagcacaaaaaggaatatataattccaaattgtgataaatgctatgaagaaaaggaatgtgctctgacataaaggggggaacgaacgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattaca

SEQ ID NO: 117887 - DNA, 702 bp, Homo sapiens
  Payload ID: 3046
  Gene Symbol: C1orf226
  Gene Name: chromosome 1 open reading frame 226
  ENST ID: ENST00000420220
  CDS Start-End: 190-702
gttaagagacccaaagcccggagagtgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtccca

SEQ ID NO: 117888 - DNA, 1049 bp, Homo sapiens
  Payload ID: 3046
  Gene Symbol: C1orf226
  Gene Name: chromosome 1 open reading frame 226
  Uniprot ID: A1L170
  ENST ID: ENST00000426197
  CDS Start-End: 74-1021
gcctggcggttccagggtgcacaccactcctcgtagcaggtcccctgtcttgtgtgctgtgtccccccgaggtatgctggtgctggtggcccaggcaggaggtgacactctcaaagtgactggtcactacgtaaaatgtgtctttcttttgtttgtttcccacctgctttccgagcccctttctcggacagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtcccagcagacgcttcacagccagaggccaccatggaaagagaagagagaggcaaagttctgcccaatggagaggtttccctgtcagtacctgacctaatccacaaggatagccaggacgaatccaagctaaagatgactgagtgcagaagggcctcctcccccagccttatcgagaggaatggcttcaaactcagcttgagccccatcagcctggctgagtcctgggaggatggcagcccccctcctcaggcacggacctccagcctcgacaatgagggccctcacccagacctgctgtcctttgaatagagcctctgctctttcctgctgagctctg

SEQ ID NO: 117889 - DNA, 4126 bp, Homo sapiens
  Payload ID: 3046
  Gene Symbol: C1orf226
  Gene Name: chromosome 1 open reading frame 226
  Uniprot ID: A1L170
  ENST ID: ENST00000458626
  CDS Start-End: 173-991
actggaaagttcaagagtgtctttgctggctctttcttgaatatttccaaagccttggaagttacaggttttgggtgtgggataaggaaaaactgaatgatagagcacaggtaccgctcccctttcctcatcatgcctctctgtcgcctctttgttcatagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtcccagcagacgcttcacagccagaggccaccatggaaagagaagagagaggcaaagttctgcccaatggagaggtttccctgtcagtacctgacctaatccacaaggatagccaggacgaatccaagctaaagatgactgagtgcagaagggcctcctcccccagccttatcgagaggaatggcttcaaactcagcttgagccccatcagcctggctgagtcctgggaggatggcagcccccctcctcaggcacggacctccagcctcgacaatgagggccctcacccagacctgctgtcctttgaatagagcctctgctctttcctgctgagctctgcccttgtcttcctgctgctttctcctccactgcgcacactggccctggcctcaactccgctgtgccctttgtcttccttgtatgaggcaccagcagagagccagtcgtccatcatgggattttgcaggactggaagtccttgagtagttctagttaaagagtctatccgcagaatggctgaaggacttgatgccgttttgagcctaattttctgtaacctcctctgagtgggctgcagcccttggacattagagctcttccactcttgagcttgtcctgtcttctcagtgaattgcagggccaccagctcaggacaatggatcttacaggaattctttttgcctgtcccctacatgcgcctcctcccctgctgttctccctcccacacccctgtcccttctctctcctccttgatgggtccgatgcccctggcctcagcgggaggaaggctggatgaggaatgatgtgtttggcttgatgacaggccatggcctagaaagccacacaccctgaccacagcccagccatagctcctcttggtcccaggacagtgcaggcccctggttgccatgtttgctctgcccctggggtggaggccagaggagatgcttaccaggcctgagaccttgagagttcacccagggtttgaacgctgccacccagggttcccaaggtttctcccatctggtcagatgtcgaacacaaaatgtgggcattctgcacggaaggaaagatcaggcttctcttgctgagtgtgtgaagacagggagagccaggccccagcagatgcggcctagcacactctgatttggttttgtggggagggcccaggaacttgggggtggtcttggcattcagagctggtgctaaaaacccagagcagaagcagggagaagggagtgaggatgggacagagaagagcgaccactggggatcagaacagcttttcaggggccaccttgcagcctaaaataatgccgtttcagggcctgggcctgctgtgagagccagaatgaagcatgtacaagattggaatgtgagaagaactgtggggggaaaccagttttaattaagtggaagtgctttgtgcttgtgctgaagttgcctgggcctcctgcagctctggacctcactggagcggccccgccctgcccttgcctgcctttcttttatgctgatgctggtgggctttttcctgcttcaggatccatgtaagggactgaccaggttcatccagccttaactggttcctgcaacccacttttaggtctcccaccaggggcctattgtgctgtcttcctgtgaccagcagatcctgtaagggggtgatcctaattctggggctctttgcagcaagaggagaacgttctttttcttgaacaaggtggccggttccctgggagaaggctgggaatggcacgtccggccagggcaggcggtgcggcatcctcctcctgggattcctgtggcctcccctgttctattcattgtttggcttcccacccataagctctgggatacccagggcttgcttcccagctcttctcatctccaagcctctgctccccttcccaccaccactgccatataaaatggccatgctaactcctacacaactaggagcctcagcaggattgctaggatgtgggttccttcctgcatgcttgcttctgcagctgtgtggccttgccatggccctcccaccactttcccttctaccttgccttccattgtcttccttctcccagaaagccaggtttcaccacgtgctcaccacaaactgtctcccctccctcgtaggagtcactgcagtagggcacctgcaggccctggtagagtgagcagggcttacgtgtacattctttctcactctaaggatgtgatatctgaccctgatgtcagagaggaggtctcaggactagcattcggggtcctttgagtgttcccagaatggtttggggtatcacacaaaacaccagagctgaggatagggatagagtccccaaacacacatcctgggagcaagccacttcatctgagcttcccataccaggagcatggtttgtgctttgatgggaaacctagcaagcccctgcactctggggcttctcctctcctggagcccagggcggctctggcccgatgatatggcagccataggtacaggtattgcaggtgcagcctttcttaagtaccctgcctccactctatagcccagctgctgctggagtccaggaccttagacccaggatgagcaaaaggatcccaccaggttgtccaggaccattgccagggtgaccccagagttcttcagacctgtgtctgatactgaatacagtgccatgggaccctgctccaatctaactgcctacaacctgcccgtccccctgctgcagggatgttgctgctacctcgggaggctctctgagactggtgtctggtcttagatgctgcacatagtacctggtgctagggtctaggggctgcccaaagcccagcaggaacagctactactcatcctgcagaggccttggcccagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctgtatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggtttggtttgct

SEQ ID NO: 117890 - DNA, 917 bp, Homo sapiens
  Payload ID: 3047
  Gene Symbol: C1orf228
  Gene Name: chromosome 1 open reading frame 228
  ENST ID: ENST00000418644
  CDS Start-End: 572-917
tgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagtgacataaccccgctgaagaaatataaaaaagcattcagtcacaaaagttcatggaaggaggcaacaggagatgaaagaattcaacaaatatttggaaggcagaaggcaggtgcagggaggctaaccggcttgaagcagaggaaattgcaagcaactgccaacaaggggagcttaccaacaagaaaccagtcaattcagccagtttgacctctaagaggcttaatgcttgaaagcacaaattaccactgaaggtcagaaatgaggttggtccgcagtcattcacctggttcttaaggccagctagatttcgtggttatctccatcctggaggctgcgtggacgcccttctggaagcacgcatcccatgtcctctggggagtagtagagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagaga

SEQ ID NO: 117891 - DNA, 502 bp, Homo sapiens
  Payload ID: 3047
  Gene Symbol: C1orf228
  Gene Name: chromosome 1 open reading frame 228
  ENST ID: ENST00000453711
  CDS Start-End: 258-502
gggcagggtcactcgtccgaacagagtcctatcctacgcggcggaagagtgtgccctttgacttgcatcgtctacctacctctgccatcctctaccagccgcaactgcgagggctggaggctagagtgcagtggcgcgatctcggctcactgcaacccgcctcccgggttcaagggatttctcctgcctcagcctcccaagagctgggattacaggtgcctgccaccacgcccagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtc

SEQ ID NO: 117892 - DNA, 1063 bp, Homo sapiens
  Payload ID: 3047
  Gene Symbol: C1orf228
  Gene Name: chromosome 1 open reading frame 228
  ENST ID: ENST00000445071
  CDS Start-End: 435-1063
cggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagtgacataaccccgctgaagaaatataaaaaagcattcagtcacaaaagttcatggaaggaggcaacaggagatgaaagaattcaacaaatatttggaaggcagaaggcaggtgcagggaggctaaccggcttgaagcagaggaaattgcaagcaactgccaacaaggggagcttaccaacaagaaaccagtcaattcagccagtttgacctctaagaggcttaatgcttgaaagcacaaattaccactgaaggtcagaaatgagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcag

SEQ ID NO: 117893 - DNA, 490 bp, Homo sapiens
  Payload ID: 3047
  Gene Symbol: C1orf228
  Gene Name: chromosome 1 open reading frame 228
  ENST ID: ENST00000434068
  CDS Start-End: 1-490
aactggagcaggagttttcccagggagccagtttgttcctggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgctcacccccagcctgccgatgtttttgcagcaggccgcggccgc

SEQ ID NO: 117894 - DNA, 747 bp, Homo sapiens
  Payload ID: 3047
  Gene Symbol: C1orf228
  Gene Name: chromosome 1 open reading frame 228
  ENST ID: ENST00000455805
  CDS Start-End: 184-363
tgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctgtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccc

SEQ ID NO: 117895 - DNA, 836 bp, Homo sapiens
  Payload ID: 3047
  Gene Symbol: C1orf228
  Gene Name: chromosome 1 open reading frame 228
  ENST ID: ENST00000441519
  CDS Start-End: 175-836
gaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccc

SEQ ID NO: 117896 - DNA, 1818 bp, Homo sapiens
  Payload ID: 3047
  Gene Symbol: C1orf228
  Gene Name: chromosome 1 open reading frame 228
  Uniprot ID: Q6PIY5
  ENST ID: ENST00000458657
  CDS Start-End: 308-1630
tgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggaggttggtccgcagtcattcacctggttcttaaggccagctagatttcgtggttatctccatcctggaggctgcgtggacgcccttctggaagcacgcatcccatgtcctctggggagtagtagagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcggggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctgtc

SEQ ID NO: 117897 - DNA, 1685 bp, Homo sapiens
  Payload ID: 3047
  Gene Symbol: C1orf228
  Gene Name: chromosome 1 open reading frame 228
  Uniprot ID: Q6PIY5
  ENST ID: ENST00000535358
  CDS Start-End: 175-1497
gaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcggggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctgtc

SEQ ID NO: 117898 - DNA, 2085 bp, Homo sapiens
  Payload ID: 3048
  Gene Symbol: C1orf233
  Gene Name: chromosome 1 open reading frame 233
  Uniprot ID: F2Z333
  ENST ID: ENST00000422725
  CDS Start-End: 82-762
ggatcgcggggagcgggcagcggggacggcggcggcgcggcccgcgtgacccagcgccgcgccccgtggccccgccgcaggatgcgcgccccgccgctgctgctgctgctggccgcctgcgcgccgccgccctgcgccgcggccgccccgacgccgccgggctgggagccgacccccgacgcgccctggtgcccctacaaggtgctgcccgagggccccgaggcgggcggcgggcgcctgtgcttccgcagccccgcgcgcggcttccgctgccaggctccgggctgcgtgctgcacgccccggccggccgctccctgcgcgccagcgtcctgcgcaaccgcagcgtcctcctgcagtggcgcctggccccggccgccgcgcgccgcgtgcgcgccttcgcgctcaactgctcgtggcgcggcgcctacacgcgcttcccgtgcgagcgcgtgctcctcggggcctcctgccgcgactacctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaa

SEQ ID NO: 117899 - DNA, 510 bp, Homo sapiens
  Payload ID: 3049
  Gene Symbol: C1orf234
  Gene Name: chromosome 1 open reading frame 234
  Uniprot ID: H3BTG2
  ENST ID: ENST00000566855
  CDS Start-End: 78-443
atttgcccctccttccagaccctggcagccaccattctactctttgcctctatgaatttgactattgtagatagctcatgagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagccta

SEQ ID NO: 117900 - DNA, 479 bp, Homo sapiens
  Payload ID: 3049
  Gene Symbol: C1orf234
  Gene Name: chromosome 1 open reading frame 234
  ENST ID: ENST00000622840
  CDS Start-End: 48-413
ctgtgtgcctccacgccataatgctggcagaactgatatttctctttaggagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagcct

SEQ ID NO: 117901 - DNA, 509 bp, Homo sapiens
  Payload ID: 3049
  Gene Symbol: C1orf234
  Gene Name: chromosome 1 open reading frame 234
  ENST ID: ENST00000440767
  CDS Start-End: 1-442
ctccgcaggcaccataggagcagtggcagcttggctgatgagctataagccagccttgtttgggttcctattccttctgctgttgcttagcaactggttggtcaagtatgaacacaagctcaccctcccagagccccagcaggaggaagagaaaccaaagacttctgaaaacgactccaagaacagcaaggccgtgaacacaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagccta

SEQ ID NO: 117902 - DNA, 3792 bp, Homo sapiens
  Payload ID: 3050
  Gene Symbol: C1orf27
  Gene Name: chromosome 1 open reading frame 27
  Uniprot ID: Q5SWX8
  ENST ID: ENST00000287859
  CDS Start-End: 126-1490
agggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaataa

SEQ ID NO: 117903 - DNA, 3754 bp, Homo sapiens
  Payload ID: 3050
  Gene Symbol: C1orf27
  Gene Name: chromosome 1 open reading frame 27
  Uniprot ID: Q5SWX8
  ENST ID: ENST00000367470
  CDS Start-End: 157-1452
gatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaataa

SEQ ID NO: 117904 - DNA, 1900 bp, Homo sapiens
  Payload ID: 3050
  Gene Symbol: C1orf27
  Gene Name: chromosome 1 open reading frame 27
  Uniprot ID: Q5SWX8
  ENST ID: ENST00000419367
  CDS Start-End: 157-1425
gatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccagctaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactgg

SEQ ID NO: 117905 - DNA, 1427 bp, Homo sapiens
  Payload ID: 3051
  Gene Symbol: C1orf35
  Gene Name: chromosome 1 open reading frame 35
  Uniprot ID: Q9BU76
  ENST ID: ENST00000272139
  CDS Start-End: 236-1027
aggcgcagtgcgcaggcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 117906 - DNA, 1610 bp, Homo sapiens
  Payload ID: 3052
  Gene Symbol: C1orf43
  Gene Name: chromosome 1 open reading frame 43
  Uniprot ID: Q9BWL3
  ENST ID: ENST00000350592
  CDS Start-End: 218-877
gtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaa

SEQ ID NO: 117907 - DNA, 1551 bp, Homo sapiens
  Payload ID: 3052
  Gene Symbol: C1orf43
  Gene Name: chromosome 1 open reading frame 43
  Uniprot ID: Q9BWL3
  ENST ID: ENST00000362076
  CDS Start-End: 213-818
gtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaa

SEQ ID NO: 117908 - DNA, 872 bp, Homo sapiens
  Payload ID: 3052
  Gene Symbol: C1orf43
  Gene Name: chromosome 1 open reading frame 43
  ENST ID: ENST00000368516
  CDS Start-End: 222-689
ctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcct

SEQ ID NO: 117909 - DNA, 1278 bp, Homo sapiens
  Payload ID: 3052
  Gene Symbol: C1orf43
  Gene Name: chromosome 1 open reading frame 43
  Uniprot ID: Q9BWL3
  ENST ID: ENST00000368518
  CDS Start-End: 127-696
cttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaa

SEQ ID NO: 117910 - DNA, 1163 bp, Homo sapiens
  Payload ID: 3052
  Gene Symbol: C1orf43
  Gene Name: chromosome 1 open reading frame 43
  ENST ID: ENST00000368519
  CDS Start-End: 179-886
ttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaa

SEQ ID NO: 117911 - DNA, 1708 bp, Homo sapiens
  Payload ID: 3052
  Gene Symbol: C1orf43
  Gene Name: chromosome 1 open reading frame 43
  Uniprot ID: Q9BWL3
  ENST ID: ENST00000368521
  CDS Start-End: 200-961
gctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtc

SEQ ID NO: 117912 - DNA, 996 bp, Homo sapiens
  Payload ID: 3053
  Gene Symbol: C1orf50
  Gene Name: chromosome 1 open reading frame 50
  Uniprot ID: Q9BV19
  ENST ID: ENST00000372525
  CDS Start-End: 44-643
cctactcgcacagcccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaa

SEQ ID NO: 117913 - DNA, 825 bp, Homo sapiens
  Payload ID: 3053
  Gene Symbol: C1orf50
  Gene Name: chromosome 1 open reading frame 50
  ENST ID: ENST00000464081
  CDS Start-End: 21-149
ggggaggataaggcgctgtcatggaggacgccgccgcgccggggcggaccgagggggtccttgaaaggcaaggagcgccgccagctgcaggccagggaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgaaatgccactatgcctcccggatgctcctggtcagcttcctgttagacatggcagtcagggcaatgaccagccacatcaacatatgctccaaattgggagccgagctgaatgactttgccgtcttcaccaccttcggcttggcctccgctctgctcctaggcgtggatggacttctgagtgggatcctggccatcatctatgtgtcagctgcttctttccacttgtgcttttattcacctggagtcccctccacatacaagggtctaccctgcccctatgcttcctgcatcttggcttccacctcccttctgaccaaaggca

SEQ ID NO: 117914 - DNA, 1011 bp, Homo sapiens
  Payload ID: 3053
  Gene Symbol: C1orf50
  Gene Name: chromosome 1 open reading frame 50
  ENST ID: ENST00000603943
  CDS Start-End: 7-336
gctgtcatggaggacgccgccgcgccggggcggaccgagggggtccttgaaaggcaaggagcgccgccagctgcaggccagggaggtatgcggggcgggagtcagcagggggaagtcagctcccgcgaggcagccggtctcggggctccgcgggaggccgacggcgggagctcacggcttgtgttcctgggtgtgtgtcgcaggagccctggtggagctcaccccgacccccggcggcctggccctggtgagcccctaccacacccaccgggccggggaccccttagacctcgtggcgctcgcagagcaggtgcagaagttttttctcacctgtaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaagggtaccagtttcttcctgagccatgaccagagccattcccagataaatgaggtttcctggaaggatgttaccagtgccttatctctggccaacatggtgctggggctcttctccatcatcttcagcttcagcaggta

SEQ ID NO: 117915 - DNA, 504 bp, Homo sapiens
  Payload ID: 3054
  Gene Symbol: C1orf52
  Gene Name: chromosome 1 open reading frame 52
  Uniprot ID: Q8N6N3
  ENST ID: ENST00000344356
  CDS Start-End: 1-504
atggcagcggaggagaaggaccctctgagctattttgcggcatacgggagcagcagctcaggctcctcggacgaggaggataacatcgagccggaggagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcagcacttgaagatcttgaaatccagaactga

SEQ ID NO: 117916 - DNA, 1219 bp, Homo sapiens
  Payload ID: 3054
  Gene Symbol: C1orf52
  Gene Name: chromosome 1 open reading frame 52
  Uniprot ID: Q8N6N3
  ENST ID: ENST00000471115
  CDS Start-End: 10-558
gcagccgtcatggcagcggaggagaaggaccctctgagctattttgcggcatacgggagcagcagctcaggctcctcggacgaggaggataacatcgagccggaggagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataataaagagtgcttgagtagcttgtctgatgtta

SEQ ID NO: 117917 - DNA, 588 bp, Homo sapiens
  Payload ID: 3055
  Gene Symbol: C1orf53
  Gene Name: chromosome 1 open reading frame 53
  Uniprot ID: Q5VUE5
  ENST ID: ENST00000367393
  CDS Start-End: 4-441
ggcatggcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaa

SEQ ID NO: 117918 - DNA, 394 bp, Homo sapiens
  Payload ID: 3055
  Gene Symbol: C1orf53
  Gene Name: chromosome 1 open reading frame 53
  ENST ID: ENST00000436652
  CDS Start-End: 1-247
tgctaacgagggaaactgcggcggctccgcgcccagcacgcccggtaggccggagagagcggcgaggccttcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaa

SEQ ID NO: 117919 - DNA, 418 bp, Homo sapiens
  Payload ID: 3056
  Gene Symbol: C1orf54
  Gene Name: chromosome 1 open reading frame 54
  ENST ID: ENST00000369098
  CDS Start-End: 39-404
tccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataataagtgaaat

SEQ ID NO: 117920 - DNA, 600 bp, Homo sapiens
  Payload ID: 3056
  Gene Symbol: C1orf54
  Gene Name: chromosome 1 open reading frame 54
  Uniprot ID: Q8WWF1
  ENST ID: ENST00000369099
  CDS Start-End: 120-515
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataa

SEQ ID NO: 117921 - DNA, 1251 bp, Homo sapiens
  Payload ID: 3056
  Gene Symbol: C1orf54
  Gene Name: chromosome 1 open reading frame 54
  Uniprot ID: Q8WWF1
  ENST ID: ENST00000369102
  CDS Start-End: 771-1166
aaagctgcttgaaaagtggaagttagccttccggatggttagggagacatggaccaggtagggtaactgtctccaccaagagactcatctgtagaaaagtgaacgcactggaaaggggagaaatctaattaaagagtcttcagagcgatgacagccagagtgtgcgagcacggaagggcgaggtatccgttcctggatcctcccctaaggcacctgactcggcctgcctaggtcagcacagccccctcacgagtctcggccttgggccttctctgacgtcgctgggaggaatataggaggaatctgtgagatccttggaaggtggaaaccaactgcgggaaaggacaaatctcccagacccaacccctcacctccgcccaaacttcacctccgacttatcgtccccaattcaggctcccaggcttgccccagttcctccagccccttccgcacctctctcttcgacgctctcccgcgtctcccgggccctctactcaccctgcgaccaggatgataacgcgaagcgggtccccagccacagtgatcaagaaaagcgcgaaggccgggccgaacgcgacgaaagtgcagccgaaaaacaccgcagcccccatggctggtcagctccagacagacagaagaaagggattcttttcagtctagaaaaatgctcaccccttcctcagaacatttccactgtgacgaaaagagactgatgaagcctcagagagaaaggcaactctgggtggtgatgcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataa

SEQ ID NO: 117922 - DNA, 2096 bp, Homo sapiens
  Payload ID: 3057
  Gene Symbol: C1orf56
  Gene Name: chromosome 1 open reading frame 56
  Uniprot ID: Q9BUN1
  ENST ID: ENST00000368926
  CDS Start-End: 109-1134
ggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaa

SEQ ID NO: 117923 - DNA, 688 bp, Homo sapiens
  Payload ID: 3058
  Gene Symbol: C1orf61
  Gene Name: chromosome 1 open reading frame 61
  ENST ID: ENST00000310027
  CDS Start-End: 1-423
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaa

SEQ ID NO: 117924 - DNA, 652 bp, Homo sapiens
  Payload ID: 3058
  Gene Symbol: C1orf61
  Gene Name: chromosome 1 open reading frame 61
  ENST ID: ENST00000357975
  CDS Start-End: 1-510
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatct

SEQ ID NO: 117925 - DNA, 867 bp, Homo sapiens
  Payload ID: 3058
  Gene Symbol: C1orf61
  Gene Name: chromosome 1 open reading frame 61
  ENST ID: ENST00000368242
  CDS Start-End: 1-566
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacatta

SEQ ID NO: 117926 - DNA, 879 bp, Homo sapiens
  Payload ID: 3058
  Gene Symbol: C1orf61
  Gene Name: chromosome 1 open reading frame 61
  Uniprot ID: Q13536
  ENST ID: ENST00000368243
  CDS Start-End: 118-588
ctcctcacagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattg

SEQ ID NO: 117927 - DNA, 473 bp, Homo sapiens
  Payload ID: 3058
  Gene Symbol: C1orf61
  Gene Name: chromosome 1 open reading frame 61
  ENST ID: ENST00000400991
  CDS Start-End: 1-199
ccagccgcaggggccacccgaacagtctctcctcctcacagaagcctggagctgggcatccaagaagaagcagcctcatttgttttctggtgtcatcgtaggtggccacctatggcttttgggaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacattaa

SEQ ID NO: 117928 - DNA, 768 bp, Homo sapiens
  Payload ID: 3058
  Gene Symbol: C1orf61
  Gene Name: chromosome 1 open reading frame 61
  Uniprot ID: Q13536
  ENST ID: ENST00000615748
  CDS Start-End: 1-471
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcac

SEQ ID NO: 117929 - DNA, 3039 bp, Homo sapiens
  Payload ID: 3059
  Gene Symbol: C1orf64
  Gene Name: chromosome 1 open reading frame 64
  Uniprot ID: Q8NEQ6
  ENST ID: ENST00000329454
  CDS Start-End: 69-578
acatcctggaagagtggcctaggacagctcctctcctgccagagctaggcaggcgccgaagtagccgcatggccccgtcagaagaccccagggactggagagccaacctcaaaggcaccatccgtgagacaggcctggagaccagctccggtgggaagctggctggccatcagaagaccgtccccacggctcacctgacttttgttattgactgcacccacgggaagcagctctccctggcagcaaccgcatcaccaccccaagcccccagtcccaatcgagggcttgtcaccccaccaatgaagacctacatcgtgttctgtggggaaaactggccccatctgactcgggtgacccccatgggtgggggatgccttgcccaggccagggccaccctgccgctctgcagagggtctgtggcctcagcttccttcccagtcagcccgctctgcccccaggaggttcccgaggctaaggggaaacccgtgaaggctgcgcctgtgaggtcttcaacttggggaacagtcaaggactcactgaaagccctctcctcttgtgtctgtgggcaggccgattagctggaagggccgggctctgatgcccagaggctgcaattcccagggcctggccctgcttccccagctaagcaggagtcttttgtgcttgagccaaggaaacatcattagatccgctaaggggcatctgaaacatccgtcgagtggcagaggcaggataagtcacctgcacatgaagagactcattcattcatacagcaaatattactggtacatcttccacatgccaggccctgcaaagtgctggggagataccatggttttcctggagctggtatttttggggtggagggaacccaccctgaataaataaagtaacccaataaataaagaagatgattttgaacagcgatgaatgctctgcaggaactgaaacaggatgctagagggagagtgattggggtgaagacctttcctgatgcagtgcttggtaagggcctctctgcgcaggcaacaaagtgtgatctaaaagatgagaaggggccagccctgagaaaatccaccctccccagggccacctgctgtcatcttaccccagggcaggccagagcagtggtcagaatgccccagcatgacggggaggggcaacgggtttcttgctgccatcttggctcagaggcgagtgtgtaggtcactgcaaaggcaggggataccacgtggggagactcgagggccatgccagttggggctgggaggctcagggaagttggctccaggagactccatcccataaggcagcccaggtgggacctggggatctgagatgggaaataaggggatctggcttctcaaaagggagggaggtactcaaaaatagagtatcatgtttgaacgaatgaaaacaagacatgttatttattgagcatctactgcataccaggctcatgctgccctctagggatagcaaaaaaaaaaaaaaaaggtggggggaggaggttcacccctcagggcaatcgtgttccctgagcaggaggtggagttactggtgtgggtgtgaaggtgtctgtgagtctaaggcatgcacagcactgtgagaaaccctaaagcaacctatttaaggaagtcagtctcaaagctcccagataaaaatcactgggtttttctgtatttattttagagacagagtctcactctatcacccaggctggagtgcagtggaacaatcacagctcactgcagcctcaaactcctgggctcaagtgatcctcctgcctcagcctcccgagtagctgagactataggtgcaccactacgcccagcttgacttcttttagtagagaagaggtctcactgtgctgcccaggctggtcttgaactcctggcctcaagctatcctcccgcttcagcttccctaagtgcttggattataggtgtgagccaccgtatctggtcattaatttattcaatgactattttactaggttcctacaaatactagctgctaacatttaacatgtaattgaccatttactctgtgtcagagaaacaacatgggcactgtatttgtgaccattttatagattagagagctgaggcacagagaggttgaagaatggactcaaagttccatagactggtaccattgagattagaactcaggcaagtctggtgcccatattcttgcttgtaactgtaaggtatataccctctcatcctggtagcgtctcttctaggcagaggggacacacagaggataaatgtaaccctgtcctcaaggagctcacagccaggtgggggaggccagaaagaaagcacacaattgccatagcttctgagaagtgcaacagtaagggcaacacagaatgatgctggaggacaaccagcccactctagagagaggagatcagggaggacttcctgcaggaagtgatgccgaaaatgagatctgaccggtgactaagctatacaaaagggtggggtgggggagcaagtggggagtgctctgggcagaaggaccagtcgttcagtctggctagggtaattgtcattcattcatttattcaccaagtatttattgggcatccactgaatgccaggctttgggctaaaccatgagatggagcaatgaataagacaatgaggcccagccacaaaatagtttatcctctagttgggggagacaggcaatgcacacacacaaaacaaacagatcagaaaggtggcaggaggccaggcgcggtggctcatgcctgtaatcccagcactttgggaggccaaggagggggaggcggggggagatcacctgaggtcaggagttcgagaccagcctggccaacttggcgaaaacccgtctctactaaaaatataaaaattagctgggcgtggtggtgggcacctataatcccagctacttgggaagctgaggtgagagaattgcttgaacctagaaggcagaggttgcagtgagccgagatctcgccactgcactccggcctgggtgacagagcaagagcaagactgtctc

SEQ ID NO: 117930 - DNA, 949 bp, Homo sapiens
  Payload ID: 3060
  Gene Symbol: C1orf68
  Gene Name: chromosome 1 open reading frame 68
  Uniprot ID: Q5T750
  ENST ID: ENST00000368775
  CDS Start-End: 1-753
atgtgtgaccagcagaagcagccacagttccctccatcttgtgtgaaaggttcgggactaggggctgggcagggtagcaatggtgcctctgtgaaatgcccagttccatgccagacccaaactgtctgtgtgacaggccctgctccatgccctactcaaacttatgtgaagtaccaagttccatgccagactcaaacctacgtgaagtgcccagctccctgccagaggacctatgtgaaatacccaacaccctgccaaacctatgtgaagtgcccagctccctgccagacaacctatgtaaaatgcccaactccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccctctctgttagtgccagtgatgtagaacctcatcactttgcctctgtgctttgcttctctaccaaggcagcctgccagagttagtacagtccccaaactttggcatgaataaagctctgaatgc

SEQ ID NO: 117931 - DNA, 4684 bp, Homo sapiens
  Payload ID: 3061
  Gene Symbol: C1orf74
  Gene Name: chromosome 1 open reading frame 74
  Uniprot ID: Q96LT6
  ENST ID: ENST00000294811
  CDS Start-End: 258-1067
atgcgcaagaaggtgcctgcgggactggagcagagcgggctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggcccggggactgaagccagctgtgctctatgattgcaactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgactttgctgatctcagcatctcctctgagatagtcacactgccggctgtggccctctgactttaactctcctcccatatagaaggtactcagtaaatgatcatctctaggttggggatggcaaataatcatctcaactgccaattccaagtgtcttgaatacactaaggcacaatgctgtagatcagttggccacaaatgcaaagggcatgtaaataggtaatggtggtgctagtagcaaattggtagatagtacatacttgccatttctatactaggaagtcctcttagtggagatgttttcattttcactggataaaagatagaaggaaggagatgatagaggaaaagcagggtgatggaagacaagccaaacactcttgcatggtaaccttgtaaatatacctgctctatgtgggtgctgcatgctaggaaagtagggctgggggcttttctgcatgtttatatgcctccaactgaatttgaggagagtagaccaccagtatgcttaaatatgtgatacttgttaatgtaatacaccattcaggaataaactgagagttctgaggaacaatctggtcaggtgaagtttatttacagtaggttaagaaattaataaaaagtcagaaatcctaagtcagttggaaaacccaagctgtaatgtacccaaaccttctgagtttttcgctgagttgcttgcttctgattttcacccaaggcagttgtcacaaattattcagatcatcaggttgtctttattggccaggaacactgccagtgctgcagcaatcaccaccatcagcactgggagccatcgcccacattgcctctgtagggggacagggagacagaagaaagtggccatgagtggattggaaaagatataggcaaaaatctttcttcttcctactctagcccagtggaaaacgctgggttggtggtggagaaaaagctttttactctgtctcccattttgtcacctgtcttgggataaaaccacttaaccaatgttctctggcccagggagccgtatccatcagggaccagatatataaatactgatatgaataatgaagggtggaaaataacccagcaaaattatattctttctttgtattccccagtacttttgtgtccttctgttcttgccaccatgcttatcatcggctaaaagaacaccctttcatactttagctaagagtaagtctttccttctggcattgagagttctgtgaaagttgggctttgatggacgagccagtgtttttttcaatggttgccataatgtcagtatagtataaaccaagcacagtgggacaggatggccagttgttggcgtgggctgatatattttatgtgcaaaacttggttaaagaaggaatcgtcccatcatccagggctttatgggaaggagagaccctcttactctgggaggcagctgctggctctggttcagctcttctcgacagtgctgcagcttacgcaggcaggagagatactcgtcactgaggttgtctaattctgaatgcagttctctgcactggggagaacatcaccaaagtcatcactgtcacttctgtctaggacagagcccaggcaggggagactgccctttgtaagtttcactcatttggaatttttaccaccatcttcccttcccagccattctcagggatttgagtttgtcttttgactgtcttacattgtctggaatgtgttcatttaaatgattgacagtaatgcatattatagtattacattttatacatttaagttcttttatatgactttacgtgcaagtgctttgcaaatgagagacaccgaaaaatgaagttcttatagaacaaacgacctagaagtgaccttagtacaagtttctttcccaggagctagttgcatatcaatacttctggggatgtgtatgtttgtgagtatgtacaaaggaagagttttactctttaagagacatataaagacttaagatactcaatgtgggacgacatattgagaagttaatatttttattaaatgtgtttgagttttggtcgactttctaaaaggtaatcatttaataaaaccttgaataggagttggtataaataaggaagggaaaagattgacaagtcagcccaaaagcacagacactttatgtaggcaaatgaatgtctgtggttatccactcacaacttaaactttgaaatccctgctttttgactgcctcccaggtttctctgctatttcgcaaatgagccctcactatctcaggtcaccctctcacctccttttccttggcctggagctgcaaagtcttcttttgcagctggtctctgagatcccagtctttctccttccctgtaccctcaggctccacttcgttagggaaggactttggactccacacgggcaaagcctgatctaaaaaagcagccagattcttggtgacagtgaggcccacacctctgaggaagggccctgagggtgaaaccactaggagtggggagaggggagggaacttgggagggcgtgctcttggctagactgatggcattctctgacataaaggttaacttccagtaggcccctgctaagcttggacagacagctggaatctgagctccttgagggcaagattgggatcttttctttgtatccccagtcttatctagtgctagatagttttagtgaatacttcttaattgaatttcattggttgtatgtcacattcttcctagtttgtcaaataagtttggtaaatgctttaatacaatcccttttccctgatgtcctcatttgaaagttgtgaagatggcagtcatatcctaaaatttatcttcatatggttaaagatggttttttagccaccctgcagtcttagtcttggtgaaaagagcatggactaggagtcagaagttttggattgttgttatagctgtgttgttagtttgtgtcaccatagactttcatgttcttatccatactctgtgagcataaaaatttctgccttatctattatattatgcccaatgattgtgaagagaaaacaaaaggtcgtgtgtagtggacaggtgaggagctattgcccctctgtatacacagtgaattctcaggaaacatggacagtagactctctagggctaacagtgagttgactctggactgctatgtggtttggggctggggagttggatgtgatttggaaaatcaagtgtgtaaaaattgacatgaaatcctgagttcaaaataaatttattgaaatgttcaacacagacatgtgctttcagagagaatagaaaccctttttcacagtttatatacctcaagatagaaggctaactagttgaagtgtcctcagagccaatgatcagtccttaaaaagctcccacacatcccggacttaacagactcccagaactggctgggactccaggaggtcatgtagtccatcccgctgcctctaggcaggtaagagaagagcaatatcttagaatttgtggtaataaatttgctgacctttctttgttaagagtttctcctgttcttgaagctgtaaggattgattttgaagcaaacctgttggaaaacacaaggaacttgtctatgctagcatatttactacaaaaagttttcttttcagaactttgcttagaaccttggttattaaatatgttcccatctgc

SEQ ID NO: 117932 - DNA, 2028 bp, Homo sapiens
  Payload ID: 3062
  Gene Symbol: C1orf87
  Gene Name: chromosome 1 open reading frame 87
  Uniprot ID: Q8N0U7
  ENST ID: ENST00000371201
  CDS Start-End: 109-1749
gggtctgagagtgtcagcttcctggggagaagcacggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatattcccagtcaagcaaatgtccactgcagctctgtaccaaccggagaccagtccttatcctatgtgcatggcattcccaggagaaagcttagagactggtccttggaacagatggtgagaggcagctctgaccaacctgaggatattggccagagcccaagtgggacaacaaatgaagacgcttttcttcttgccctggtcagaagagaactcaagtcacgtcctttgagttccaacttattagaaaagcttcagaaagagctgaagatcctggacccaatctcttcaggatttcttctccaatctcagctgagccgcctctttttgaagcatgaagtccctctacagttaccaacagttaaaatcctttgtcagagattttctaagaggggttctcctgaaatggtgaattatgaaaagctactctggtttttaaacagtgcagcatcagattatccacagcaaaataaagcagctgcagacctgagaaaaactgagagtcatggcactcatagccaaagcactccacctcagcactccagctcacagccagaagtgaacaggagtctgttggagattttgaagatggcactaaggacaaccaatggcagactcaacatagacaatctcaatctgagttttcgaaaagaagatcgctcgttctctggctgcctccctctacctaaggtcagggctatatgtgggaagcatggattatatctgaccctgagcctgctggaaacattgcttaaccatcaagatttgggttaccaaaatgaaataaaatggcagaattttgttgagatgctgaccagagcttcttctgatttgttatctgatttgcctacagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatatta

SEQ ID NO: 117933 - DNA, 1307 bp, Homo sapiens
  Payload ID: 3062
  Gene Symbol: C1orf87
  Gene Name: chromosome 1 open reading frame 87
  ENST ID: ENST00000450089
  CDS Start-End: 75-1028
cggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatgtcagggctatatgtgggaagcatggattatatctgaccctgagcctgctggaaacattgcttaaccatcaagatttgggttaccaaaatgaaataaaatggcagaattttgttgagatgctgaccagagcttcttctgatttgttatctgatttgcctacagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatatta

SEQ ID NO: 117934 - DNA, 2136 bp, Homo sapiens
  Payload ID: 3063
  Gene Symbol: C1orf94
  Gene Name: chromosome 1 open reading frame 94
  Uniprot ID: Q6P1W5
  ENST ID: ENST00000373374
  CDS Start-End: 540-1766
acagctggggagccagcccggtggccctgggcgggcgaatctcctcagaatcgcgggcctggtccccacccccaacacgcttgtatgcccgcccctcccgacgccgccttgctgggtgccaagaaccaaccgaagcagccagaactcctcagtgaaaggcctgctttatgttcccggggcagtgaggagggggcttctcccttcccattgtccagactcagcccccgaaagagagggctcagccttcccaccagccctggagaggaggaagggactgactacgccagcaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacaggggccgcatcctaggtgactccaacttgcaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgacaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaggttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcatctatatttagctaacatgagtgatttttgtttttgtttttgttggtaaaatagaagtaagacacttaattttagaaagtttgtattttatgataaaagtatgagctacttgaaa

SEQ ID NO: 117935 - DNA, 2287 bp, Homo sapiens
  Payload ID: 3063
  Gene Symbol: C1orf94
  Gene Name: chromosome 1 open reading frame 94
  Uniprot ID: Q6P1W5
  ENST ID: ENST00000488417
  CDS Start-End: 121-1917
ctccacccacccctcccacacaaatagaaggcctctgaacctaaccaccttgctggagcgaaagccagacagaactgacccacttctgccaagccccatcctcatctccctttctggtgaatgaggggtggtggtggttgtgttctagccctgggtggacagaggggcttccagaaagagaggaggaggatggccagcgggaatgggcttccttcatcctcggccctggtggccaagggcccctgcgccctgggcccattccccagatacatctggatccaccaggacacaccccaagacagcctagacaagacttgccatgaaatctggaagagagttcaaggcctgcctgaggcctcacagccctggacctccatggagcagctctctgtccctgtggttggaactctaagaggcaatgagctcagctttcaagaagaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacaggggccgcatcctaggtgactccaacttgcaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgacaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaggttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcatctatatttagctaacatgagtgatttttgtttttgtttttgttggtaaaatagaagtaagacacttaattttagaaagtttgtattttatgataaaagtatgagctacttgaaa

SEQ ID NO: 117936 - DNA, 7705 bp, Homo sapiens
  Payload ID: 3064
  Gene Symbol: C1orf95
  Gene Name: chromosome 1 open reading frame 95
  Uniprot ID: Q69YW2
  ENST ID: ENST00000366788
  CDS Start-End: 106-531
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccatttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctcagcagccgcccccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccagccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccaggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 117937 - DNA, 4093 bp, Homo sapiens
  Payload ID: 3064
  Gene Symbol: C1orf95
  Gene Name: chromosome 1 open reading frame 95
  ENST ID: ENST00000366789
  CDS Start-End: 106-531
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccacttccacaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctc

SEQ ID NO: 117938 - DNA, 2120 bp, Homo sapiens
  Payload ID: 3065
  Gene Symbol: C10orf10
  Gene Name: chromosome 10 open reading frame 10
  Uniprot ID: Q9NTK1
  ENST ID: ENST00000298295
  CDS Start-End: 219-857
cacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaattacccagtttccttatctataaaatggggacatcagcaatgttcttcacaccctgcaagggctgggaatctgcgcatgtgaacttggagctgcatttatgagcactgtagacaaatgtttgtatctgtcac

SEQ ID NO: 117939 - DNA, 613 bp, Homo sapiens
  Payload ID: 3065
  Gene Symbol: C10orf10
  Gene Name: chromosome 10 open reading frame 10
  ENST ID: ENST00000448778
  CDS Start-End: 362-613
tgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggaagaaaagatcccagcagtcggagctctggtctgggctctgtagacttcaaattgctctcagggcaccggattcctacaggcagccccagaggagtgtggtgacgctgaggggcggtgggacgcatggcaggccctcaccaccaggcttctgtttcccaacaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagac

SEQ ID NO: 117940 - DNA, 4730 bp, Homo sapiens
  Payload ID: 3066
  Gene Symbol: C10orf105
  Gene Name: chromosome 10 open reading frame 105
  Uniprot ID: Q8TEF2
  ENST ID: ENST00000398786
  CDS Start-End: 103-504
ctcgggcttcttgtggagaggcaggagagtgaaggcctgccgcgggtgaggcctccagtccacggacggccacaggccactgcggctggaatcacaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagccccagtgagccccagctccggctctggaagcgcctgggctccttgcgcctctccctgcacagcttccgccatggccggcccaccgtccctcgacagcccctgccgggccccgaggacaaccgcagccactgtgactacatggaatctaccaagatgtaatggggtgtccacaaacatgcccccacatccccctaggtctacctgtagatcctcctgcttcagagaccggtgctgcaggctgcaggaagacagtggcccaagcagtctgggacacacactcaccccccgaagctccttgcatgcccaggccagcgccctttcccaaagatgatcctcagaagagcaccttcctctctgcagaccccctcgctgctgcttgatgaaagacttctggtcaagagatgtgcactcgtggtcatctgggcctttggcctgaggctccacagggtacaacctggggctcgtaaccacctcctagaagcagcaccctcgctcgccacagaagccttgccctccaggtgccaaagcccagcatggagaagttgccaaatggcaaaggttccctttagtcaagtgaaatgctcagcctacaccggggccaagacactgtcctggcatctgtgctggcccagtgctggggcaaaacctcggggctctcttccttgggtttcccgggtgctgccagcatctgcctggtgccctgtgggagcagctgcctccctcctggtggaacagatgcctgggtgccagctgggaggaggagcaaacagggctctccaagcatggtcttggcagccgtcttggtggcccctcttcagggcacccacgttgggatcaatcaggaagggattgaagatgatcgaggaggctcccttcagaggccagggcgggtgctgtgacagagtggcaagaggcagggcatttccagcagctggaggtgatgccacctggactcggaggaggacagctcacagcagctccacacctcacccagggaaagcggcagcctccccgagggtgggatggtctggacctctccaggacagctgtggggtcccaagtcctgcccacactagggatgctatctgtggttttggtgagtgctttgctgatgacccgtcaaagcagtcccaccccaggatgggcttctcagaatcccaaacccttgacctctcctcacaacgcgagggttaaacactttggtcaggtcccaaatttgaagggtgggcagagggaggacctgggctgcccagctcctgtcccagtcagctggccaggatcccaccacaaagctgccccacccccatcctgctgtgacccacagtgcagccagccacgtctccccaaggagtgagctctggcttgccactccccagctccaaaaccttcactggctccctaatgccaaatggatatagccaaagctcctcagcgcagtgtgcagtgccctctgggagctggctccaattaatctttctagcctcatcttgatccaaaactccaggaaaactgaaagacctgtcacccactaactgtggcttatgcttcacacacacccactctgtgaagccctcctgcctggagccgcccctactgtctcctacctctcttggggaggaaaaggaacattctcttggcagcatgggtcctttttgtctatgtcttctctttcctaccagcttgggagcttgcagagagccagacattgtccagcccctcactttgactccccagttctgtgcacagaagtatgaggcttctgtgtacagagtgaagcgtggcccagcctgggtgtgtccccaccctctgaggcaggagtcttggtggaagctggcataacacagagcctcatcttccctcagatgactctagaaagatttctctccaagcaggctctattggagaagcccactgtcccttccttccaagtcaatctgatctcaaaaagtgagtccggcttcacaagaaacttaccaagaggaccttggagaagtcatcctgagacgctgcatttctccctgagaaatgggagaactcagggctgccctatattaactcgctggctctaggatttcagtaagagtagtattgtgtaaatagaaaccaagtctttgggtttagaaagtggggcaggcctcctccctaagggttttgttccttcctcccttcctgctcagtaacctcttcctggtttgcttcccctggggcctccctgcaaatcctaggctggattcagcctgtagccatccacctcaccagcaggccctgctggccactaggcactgtcttcctggaggttggggtgggggttgaggctgccctgaggcctgaagaaggaaaagtccaggagggggagggctctcaattgggtttcaggcaccaggccaggggggtatgctccaagtcctcacaagctgaggccctgatcgagagaaccctctacttcctccttctggagctagccaccacactctcgcaaatcctcagggctttctgggctctctgtgtttctgggagtcagctccctgctccccagccctttcctgcccgcctcctggtcccgatgcagggaggggagcattgccagcctcccacgcttctgtccctcccaagcccgggagcctgccccagtgggcaggcccagattccctgtttggctcagcctccgagtcggaaaccccatagttggtaaagagactcattcactccgggcctccctccccacccagcaactgaggcctctgggcagaggtgtgggtgcacacccaaattgttttcagggtcctcccttctctccctctgagccttggagctgttgcgcctgctccctgggcaaaggagccctttcttcttgtgcctgtttacttcccaagaggggagcctcggccaagggctctgtgaaagcagctctgttctgggccttgctgggccctggctctcttctcaactcctttccgggaaattgtgacgtctctttctccccgctactctgaaaggcccttctgggtggggcgggagatatgcagggggaggccaagtcttcctcctgtttgtggggagccagagccctatcctcagctctgcaacctgggggcccacactccctgggatgggagagggcctgggtccccctttccccacagcaccttccagagcagcggacccaccctgggcccccacctgcttccgcctctggtgccactgagcatgtgccctcagggccgtgtgtggctccgcctcccccagcccaccacctgccccagaggccacgggccacctgcctgcaagatgctgtggccttcagggatgtcctcagggacgctggcctcatagctgctctgcagaaagatgggccggttgtcattcacatccaggacagtgacgaacacggtggctgtgcccgtgtgtcgcttccctacagggccgttgtctgtgggagttgaaggaagacaggtgttagcagctgcctgagagaggggcacacttcctgtgactttgcacactcccgggcaccggccagagaggtgccctgttccgccccatctgccctagcctttgcaaggggtgacttcctttttagcttaggaataacactaacagtatcaaatacttagataacaccatgtgccagccattcttctaacccattcagtcctcacagcaaccccatgaagcagacactttactgtcatccccattttacagaggaggtaactgaggcactcaagtggattgaatgatggctcccaaaaaaaacagacccatgttaaacccctgggaacctgtgaagattaatttatttgggaaaagggcctttgaaaatgtaattacgttaaggatcttgagaagtgatcatcctgggtgagctgggtggcccataaacccaatggcaagtgtccttacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatcttt

SEQ ID NO: 117941 - DNA, 4837 bp, Homo sapiens
  Payload ID: 3066
  Gene Symbol: C10orf105
  Gene Name: chromosome 10 open reading frame 105
  Uniprot ID: Q8TEF2
  ENST ID: ENST00000441508
  CDS Start-End: 201-602
ttctagacaaagccaggtccagctggggagtgacggggaggccactctgctggccaggctgaccgagggctgcagggcacagcagagcctggcagggctggggtcacaggcactgcccagggctccttgggcctcccttccacagctgagaagacctctccacggagctccggacggctggggtctggctctgaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagccccagtgagccccagctccggctctggaagcgcctgggctccttgcgcctctccctgcacagcttccgccatggccggcccaccgtccctcgacagcccctgccgggccccgaggacaaccgcagccactgtgactacatggaatctaccaagatgtaatggggtgtccacaaacatgcccccacatccccctaggtctacctgtagatcctcctgcttcagagaccggtgctgcaggctgcaggaagacagtggcccaagcagtctgggacacacactcaccccccgaagctccttgcatgcccaggccagcgccctttcccaaagatgatcctcagaagagcaccttcctctctgcagaccccctcgctgctgcttgatgaaagacttctggtcaagagatgtgcactcgtggtcatctgggcctttggcctgaggctccacagggtacaacctggggctcgtaaccacctcctagaagcagcaccctcgctcgccacagaagccttgccctccaggtgccaaagcccagcatggagaagttgccaaatggcaaaggttccctttagtcaagtgaaatgctcagcctacaccggggccaagacactgtcctggcatctgtgctggcccagtgctggggcaaaacctcggggctctcttccttgggtttcccgggtgctgccagcatctgcctggtgccctgtgggagcagctgcctccctcctggtggaacagatgcctgggtgccagctgggaggaggagcaaacagggctctccaagcatggtcttggcagccgtcttggtggcccctcttcagggcacccacgttgggatcaatcaggaagggattgaagatgatcgaggaggctcccttcagaggccagggcgggtgctgtgacagagtggcaagaggcagggcatttccagcagctggaggtgatgccacctggactcggaggaggacagctcacagcagctccacacctcacccagggaaagcggcagcctccccgagggtgggatggtctggacctctccaggacagctgtggggtcccaagtcctgcccacactagggatgctatctgtggttttggtgagtgctttgctgatgacccgtcaaagcagtcccaccccaggatgggcttctcagaatcccaaacccttgacctctcctcacaacgcgagggttaaacactttggtcaggtcccaaatttgaagggtgggcagagggaggacctgggctgcccagctcctgtcccagtcagctggccaggatcccaccacaaagctgccccacccccatcctgctgtgacccacagtgcagccagccacgtctccccaaggagtgagctctggcttgccactccccagctccaaaaccttcactggctccctaatgccaaatggatatagccaaagctcctcagcgcagtgtgcagtgccctctgggagctggctccaattaatctttctagcctcatcttgatccaaaactccaggaaaactgaaagacctgtcacccactaactgtggcttatgcttcacacacacccactctgtgaagccctcctgcctggagccgcccctactgtctcctacctctcttggggaggaaaaggaacattctcttggcagcatgggtcctttttgtctatgtcttctctttcctaccagcttgggagcttgcagagagccagacattgtccagcccctcactttgactccccagttctgtgcacagaagtatgaggcttctgtgtacagagtgaagcgtggcccagcctgggtgtgtccccaccctctgaggcaggagtcttggtggaagctggcataacacagagcctcatcttccctcagatgactctagaaagatttctctccaagcaggctctattggagaagcccactgtcccttccttccaagtcaatctgatctcaaaaagtgagtccggcttcacaagaaacttaccaagaggaccttggagaagtcatcctgagacgctgcatttctccctgagaaatgggagaactcagggctgccctatattaactcgctggctctaggatttcagtaagagtagtattgtgtaaatagaaaccaagtctttgggtttagaaagtggggcaggcctcctccctaagggttttgttccttcctcccttcctgctcagtaacctcttcctggtttgcttcccctggggcctccctgcaaatcctaggctggattcagcctgtagccatccacctcaccagcaggccctgctggccactaggcactgtcttcctggaggttggggtgggggttgaggctgccctgaggcctgaagaaggaaaagtccaggagggggagggctctcaattgggtttcaggcaccaggccaggggggtatgctccaagtcctcacaagctgaggccctgatcgagagaaccctctacttcctccttctggagctagccaccacactctcgcaaatcctcagggctttctgggctctctgtgtttctgggagtcagctccctgctccccagccctttcctgcccgcctcctggtcccgatgcagggaggggagcattgccagcctcccacgcttctgtccctcccaagcccgggagcctgccccagtgggcaggcccagattccctgtttggctcagcctccgagtcggaaaccccatagttggtaaagagactcattcactccgggcctccctccccacccagcaactgaggcctctgggcagaggtgtgggtgcacacccaaattgttttcagggtcctcccttctctccctctgagccttggagctgttgcgcctgctccctgggcaaaggagccctttcttcttgtgcctgtttacttcccaagaggggagcctcggccaagggctctgtgaaagcagctctgttctgggccttgctgggccctggctctcttctcaactcctttccgggaaattgtgacgtctctttctccccgctactctgaaaggcccttctgggtggggcgggagatatgcagggggaggccaagtcttcctcctgtttgtggggagccagagccctatcctcagctctgcaacctgggggcccacactccctgggatgggagagggcctgggtccccctttccccacagcaccttccagagcagcggacccaccctgggcccccacctgcttccgcctctggtgccactgagcatgtgccctcagggccgtgtgtggctccgcctcccccagcccaccacctgccccagaggccacgggccacctgcctgcaagatgctgtggccttcagggatgtcctcagggacgctggcctcatagctgctctgcagaaagatgggccggttgtcattcacatccaggacagtgacgaacacggtggctgtgcccgtgtgtcgcttccctacagggccgttgtctgtgggagttgaaggaagacaggtgttagcagctgcctgagagaggggcacacttcctgtgactttgcacactcccgggcaccggccagagaggtgccctgttccgccccatctgccctagcctttgcaaggggtgacttcctttttagcttaggaataacactaacagtatcaaatacttagataacaccatgtgccagccattcttctaacccattcagtcctcacagcaaccccatgaagcagacactttactgtcatccccattttacagaggaggtaactgaggcactcaagtggattgaatgatggctcccaaaaaaaacagacccatgttaaacccctgggaacctgtgaagattaatttatttgggaaaagggcctttgaaaatgtaattacgttaaggatcttgagaagtgatcatcctgggtgagctgggtggcccataaacccaatggcaagtgtccttacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatctttaaactttca

SEQ ID NO: 117942 - DNA, 1685 bp, Homo sapiens
  Payload ID: 3067
  Gene Symbol: C10orf107
  Gene Name: chromosome 10 open reading frame 107
  Uniprot ID: Q8IVU9
  ENST ID: ENST00000330194
  CDS Start-End: 306-932
gagattgcggcgatgtcgcaggggacgactccctgggggccgaccccggcgggaaccacgcccgaatcggaggtacaccgcccctttcccttcccggtaccggtgccggtaccagagacctccgagcgctcattcccagtccgcggagtctgcggccaagccaaatccggtctccgaagaggcgccgcacgtctggccccggctgaaaactgagaatatttttgaatttcaaaaaccttgaaacttgtttaaaggatgccattctactagattattatgtatctggatttttgtgggctagaggaatggatttctctattattcagtattcaaaatttatgactttactagctatgtcacttcaaaatcttaaaacactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactgagcaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggttttaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcatcttcaaggagaatgaagtcaactttttaaataaccagaaataaagaaagatgataataacttcatccattttgacccaaacggactgccacgttactggaacactgtgaaaacataccagtaccacactattgaggataaaatttgttaaacaatagcaattcaaatgcatatatgaggttttttttttttttactgaaatcatttggttttcttatttaaacgtttcagtgtgaaaccaattttctgaaattatataatgcagtttgaagcactttaatttattctgtactgtatttgttatttctaatcttgttactctcccaggagaatacatgacctatataaaaagaagcaatgtataaatggttattaaagaccaacctatatatagattgtaaaaatcttaaatacaaatcaaactcatagagttcccagaa

SEQ ID NO: 117943 - DNA, 253 bp, Homo sapiens
  Payload ID: 3067
  Gene Symbol: C10orf107
  Gene Name: chromosome 10 open reading frame 107
  ENST ID: ENST00000389639
  CDS Start-End: 45-253
gggccgaccccggcgggaaccacgcccgaatcggagcactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactga

SEQ ID NO: 117944 - DNA, 899 bp, Homo sapiens
  Payload ID: 3068
  Gene Symbol: C10orf11
  Gene Name: chromosome 10 open reading frame 11
  Uniprot ID: Q9H2I8
  ENST ID: ENST00000372499
  CDS Start-End: 216-812
gttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaacaa

SEQ ID NO: 117945 - DNA, 3923 bp, Homo sapiens
  Payload ID: 3068
  Gene Symbol: C10orf11
  Gene Name: chromosome 10 open reading frame 11
  ENST ID: ENST00000496424
  CDS Start-End: 877-1044
agatgccactgtgggcactggcagaactgggccccctgtagatcagatagaaacaaatgggaagctctgggccattgccttcaaaaggctttcttattccagagaggtttttgacataatcctcccctccccaccagcctctgctgtgaccagcttcttacttgaattacccttcagctccctcgctcagcttcatgctcagcatttgcccagactctgacctcttctccattgggatctttttcttggtctcttggttccagactcaccctcatccctaccttgccttttgttttcctcccaatttcttggcttctggctctagacaggatatggctgttcctgctttcaaacctgtctattattcccaacttaatctgtctgtcagtgacaccttctctcttgctttactgaaaggcatggcaccttaatctgtgagaggggtgggaagcttcagccttctacctggttctttagtttctctaacttaatccttcagaagatggcaagtctttacttttggattctggcaatgtggcccacactttcgtgttgaattacagtcatggtatgtagttttttttttgtttgtttgagacagagtctggctctgtcgcccaggctggagtggagtggcacgatctcggctcactgcaagctccgcctcctgggctcacgccattctcctgccttagcctccagaatagctgggactacaggcacccgccaccatgcctggagaagtttttgtatttttagtggagacagggtttcaccatgttaaccaggatggtctcgatctcctgacctcgtgatccacccgtctcggcctcccaaagtgctgggattacaggcgtgagccactgcgcccagcccatggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaacaatagcccacattgcctctctttgggaaaagctatgacttcagcttttggtaccttccgctgactttgccaggcctgtcaagatgatccttctgccttagactgagtggtcacatagagattgacatgattgcccttaagcaggtctcatccaccagggtgacagacagcggtggcaaagcaacagggctgacagcatgaacaccatgatagattgcctggtcctgccactgctcacaggggagcagaggtcacacctggggcctccctggacatgctcagtggctgcagtcaagtgagaaagactgtcctcagctcgcctattgaattgaaatccctctgataccatcgtgctgtgggcttatttttagtgaaatagtcacagtttaggggatggccattctccctcactccttttaaatcttaacgtcctgtattctgcatatacatagctcccgtctcttcccctccaccttcctttagcatcgattttatgacaggtggtgcatttcagtttgcagtttttcggagaacaaggtataacttcccagccaggtcatacatttatggctggcttcatgttgctacaatccctttattggcgtaaatagctttccctaaatccctgactacaaaagcgtggacttttatcttgtttcattcaactctaaatccacttcttgccctgaatatgatgcagtgtaaggcataaggcatctttctcagcatgagggtttggttgcaccagggactcttatttattaatttatttttaaccgtacacacttccagtgatgcctgtggccatacttgtgcgtggggctggcttgctcctttgggtgctatttaaagggagtgaggtgatgaaagatagagtgaagggtcaggaggttaaaaaacaaaattaagactgttgaaaacacccaccagaccaaagagtttttatagaaggcacaaaccttttggattttgcatctttgtcatgacctctcagaaatcaaatccacaggttgtgagacagtgctctgtcttcctgtatgcttggctgtgcactagcactaatgtcacaaggaacataagtgtgatcattgctagttgggtgactcaaagtttatctaacttgctggtgcaccagtcaaatcactctagaagatgttcaaaaggttgattgattgttcttgacacgatagtgtttatttttctgcttcttccatttagaccaagtgttcattgtcctcccagtattaggtcagtttgatgacagcaaaacctgaaagagaatccctccaagttatagatactgagggactaggagctgctattgtaaaactatggggactcagaatccctaagctgcccaaggagaacctactttctcagctctagcccgtttacatagcctctggcccactgagtcaacacaggccttgaatgacatgtattgaggctggcaggagtccctgtttgagattacacaacctttgttaatcagttctttagacaagttaacattaaaatcctcaaaaccatgaaaaattggagaatgttgaatgtttgcatttatctctcaaatccattagtaactggatttgagtaccttttctctgtttgatctacaaaacagcactggaaaaatgctttaaattatctgcatttggtcccaccctgggtcattgtttagaagcatcaacacatgttttctccctggcataatatgggcagccagaattctgtgcaagggcagctagacgagtcagatgtcatatccaatctagccacacatatatccttgtctttataaaaggctttaaccctgcctcaaacaataaaaaagcacttgtgaactgaccacagaatttttccatctttatttttcttacttgtttactttttttaatgtcagaaccatttgtatcatgcgcaggaatgtctccctcaatgtgagctttggaggcaaaacatatttttggagtgagttattgaccacattgtttccctctctttgggttgtttattttcttccagaatggtgtaataactttaattaagattagctttaattataaattacctaaaggccatcactaaggtatattcatcttattgatagaattatagtcagctttgtttctcttaagcagggatagtgataatgaagtgctgggttggttacagttccactgtgtgttaaccaaaatttgctgtgctagagctagactttggtctgaattggcagaggtagaacccatgttgcatgtttatcctaaatctgtaggaatttcccaaaccttgtttttcaaagttgagaagtagaaagtaataaattcaatcagggcccagacatgttttgtaccccctttaccctttggtctttcttccttttatcctattccactgagcttgttctttggggattgtggtgcctgacatcactgtctttcctcccctaggacactgacttgagtggagagacctcggcaattcaaggctgtcctgcagctctctgttgcctcagcaatgtcaggacgactgtctctttcctaagtaacataattttaaagaacaatttgttcctcagggaataatgtcttggattgtggggaatcctattaaaagtacaactattgcagtcatttgcttttacttttaccagcctcactcataaaccctccatctgtttgttgctttaaatagaagcacattataagagattatcacttgatcaggctgcatgtctgagtgttgtgtgttttcacatactcatgtatactaaggaataaaagaaagcaaaccac

SEQ ID NO: 117946 - DNA, 1040 bp, Homo sapiens
  Payload ID: 3068
  Gene Symbol: C10orf11
  Gene Name: chromosome 10 open reading frame 11
  ENST ID: ENST00000611255
  CDS Start-End: 273-953
cggggtcaggccgccgtcggggcgcggggcgctgcgggccacctgttgcagcgggcggccagggctcacctgcgcggagaccgggccgaggggcggcggcggcgagcggcggagctgaggtccccgaggctagcccgcgcctccggcttccgccgggtcagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtgtcctacataggccaggactgcagagaaattccagagcaccttggcagggactgtggacatttcgcaaagaggcttgatctgagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaacaa

SEQ ID NO: 117947 - DNA, 393 bp, Homo sapiens
  Payload ID: 3068
  Gene Symbol: C10orf11
  Gene Name: chromosome 10 open reading frame 11
  ENST ID: ENST00000611306
  CDS Start-End: 1-393
aggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggtgagc

SEQ ID NO: 117948 - DNA, 579 bp, Homo sapiens
  Payload ID: 3069
  Gene Symbol: C10orf113
  Gene Name: chromosome 10 open reading frame 113
  Uniprot ID: Q5VZT2
  ENST ID: ENST00000534331
  CDS Start-End: 52-519
atgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctga

SEQ ID NO: 117949 - DNA, 614 bp, Homo sapiens
  Payload ID: 3069
  Gene Symbol: C10orf113
  Gene Name: chromosome 10 open reading frame 113
  Uniprot ID: Q5VZT2
  ENST ID: ENST00000529198
  CDS Start-End: 52-291
atgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcttgaagaacggacagctgcactttatcccataggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctga

SEQ ID NO: 117950 - DNA, 4929 bp, Homo sapiens
  Payload ID: 3070
  Gene Symbol: C10orf12
  Gene Name: chromosome 10 open reading frame 12
  Uniprot ID: Q8N655
  ENST ID: ENST00000286067
  CDS Start-End: 108-3851
attgttcctcagtgaacttccaccacatccctaaaatcttggaggggcagaccactggacaagagcaagacacaaatgtgaacatatgtgaggatggtaaagaccatatgcagagttcagctttagtagaaagtctaattacagtaaaaatggcagctgagaatagtgaggaaggcaatacctgtattattcctcaaagaaatttgttcaaagctttatcagaagaggcttggaactcagggtttatggggaactcatctagaactgctgacaaagagaatactttacagtgtccaaaaacacctttgcgccaggatttagaggcaaatgaacaagatgcaaggccaaagcaagagaaccatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaagcctttcaaatttacagttaatggagaacaccgtaatttgagatgtcagaaaatgcatctcagatggagaagggaacttgcagagtccttctctgaggctaagggaagttatatattatattctggttgttccttgggttttaaacttggaaccaagcagttttcgtttttaaaagtacagtgccttatttatcctttttgtttttaaatttacaaaagctaaaaagctgatctatgtgattaaaggcttgtattttatacttgatgcacaagcacttgtactgtagccgagaagaccaccatcatgcacataaaaggagcttttcagcagccaccctgcagcatctgcccacgaacagatgcccttctttgcaaaccccagcagtgaacttccctctctgtcttgtttgtttgtttagatgatgtttgaaagctaaaccaaatcattttatggtatgcagaggatttataattataaaagattactatttctgttacccccttttaaaaaagatcatgttcattgttggtccctcctctcacctttgatgttttgtcatttgagagcatgtattctaaattatgtgcccatgggacaagagatatgtcacaagtgttaatttttgtttacaaactctaaaaaatcatttgcatccccaaactgtattactaattctcaccatcttcttcatttctggtcttgctagcactcctgcaaggcttccatcctacttcgggaggaaaaagcctaggattttttttttccatcttgtagctgtaatttgatgattaggatgaaaatgactcttattttctttcttacccagagtacttccatattcaaagaaagccgaactattatttccagtaatagaaaggtttaagaatatgtatgtccatgtgtgtttgggtgcatttgcatgtggttatcagccacaaatgtctcccaatcccaattttacagtaaaattttttccctatgcagtgtg

SEQ ID NO: 117951 - DNA, 1064 bp, Homo sapiens
  Payload ID: 3071
  Gene Symbol: C10orf120
  Gene Name: chromosome 10 open reading frame 120
  Uniprot ID: Q5SQS8
  ENST ID: ENST00000329446
  CDS Start-End: 33-1040
gaacacctcccgtcctagcttattgccggagtatgatcagagaatggaagaatgactgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcaggtgaacgtcagtaagcacatagagaggatgaggcttgctcgggctctgggaaatcatcagcctttaccctacattgaaaggtttacacgctcctcatttctgtctggggtgggcctgggtccaatggcaaaaaataaggccagacgaaaggaagacaactatgacacccataattgtgatgatgccaaccaagataagaaagaggaggcagagggaaaaaacacaaaaagacgagaaataaaaatgaatgtagttttcaagtcaaaagaaccaaaaaaatgtttaacataccatggaaatgatcgcaaatcattcctccccgcaaagaaaccggaacggtccatcgcaggcctaacaaaccgaaatcttttctgcatatcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaa

SEQ ID NO: 117952 - DNA, 628 bp, Homo sapiens
  Payload ID: 3071
  Gene Symbol: C10orf120
  Gene Name: chromosome 10 open reading frame 120
  ENST ID: ENST00000432000
  CDS Start-End: 1-479
actgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaa

SEQ ID NO: 117953 - DNA, 1756 bp, Homo sapiens
  Payload ID: 3072
  Gene Symbol: C10orf128
  Gene Name: chromosome 10 open reading frame 128
  Uniprot ID: Q5T292
  ENST ID: ENST00000374148
  CDS Start-End: 56-535
attgtgcctgcgctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagagcccacgtcctcagggacggtcctgccttgggacctttgcacttgctgttttctgtaattggaatgctctttgccagaaagctgcaagcctcgaccctcttttccttcaaatccctgcttcagtgtcaccactgcatcatggagggcctatttaaggcgaaaccacaatttctccaaaaggtgagttgtaagagtgatcacttgtcttaaaaggaggacaggcagtctctgccccatggggctgcatgggttttcggcatgacctctccctcccctggccacgtgggacgggcaaccatggcatggccaggagccctcatgccaggacagctgtgagaccaggaatcagcatcaccttgggacatgatggtacttggcaagatttaacatgaagctgtggggcatttgcccagttagagctgagaaaatggttttaacaggataggtaaactttttttcattctccaagacctatcctatgatagtgtccaatctaataattagccaatttagtccatttgatgaaaaaaattcccaaacatctcttcatgtcatcatgctatcagtttggctgggtatttgcatctcagtgctgctttggggtctcggagaggacgaagcctgtatgtggagggccggtctacagaaggggacaggatctcggacccctgattgaatgagcctatggatgaagactcctaggaatgaaggcatcttcaccagggttttgagaatcatcatttcacaatccacattccccagcttggcttttcctcacctcatgccccttgcatgtgccaaacccactgagaatttgctccctgtctgaccagcccaggatggtcacacaggcctggggcaatctcttgacctcactctcctgctttatgaaaaattttcaaatccaaagaaaagttgaaagaacgggacaatcaaaatatatacacccttcacctagggtcactcactgacacggtgccccctttgctttatctctgtgtacataagccttttttgactgatctacttgcaaattagtgtagatatcatgatatttcacccctgaatacagcaccattgtgtttcctattgtgtataatcacaatacagtgaccactcctaagaaaattaatgctaatttaatatcatctattatacagtccatatttaaatttctctggttatttcagaagtatcttttattgctctattttttattgtgctattttccaatccagaaaaaatatttgtatttattttgtcttttttttaagtctctttcagtattgaacagcccctctgctttttatccttatggcattgttaattgagaagtccctaagccccgttgtcttatacaatgtcccattttctggatttgtctgatcgttttctcctgagtagattcagattgaagtttttggtcagaaa

SEQ ID NO: 117954 - DNA, 1971 bp, Homo sapiens
  Payload ID: 3072
  Gene Symbol: C10orf128
  Gene Name: chromosome 10 open reading frame 128
  ENST ID: ENST00000374151
  CDS Start-End: 83-505
acatggctcattgtgcctgcgctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagaaagctgcaagcctcgaccctcttttccttcaaatccctgcttcagtgtcaccactgcatcatggagggcctatttaaggcgaaaccacaatttctccaaaagcatctggccagatctgtgcaaattcaccaactacagaaagtgaaaagtttcccaaaatatgcctattaacctcgaggaatgacttctctttttgtcatcaaagtggatgaagttttgtttgccttgggtttggcaggcagaaaacaacttccaggttgagctctcccctttacccagaagccactggccttcagttcctttctatgttgcacaaggaagtggcccaccttgcaggctttgctgatgagcttttatacctgtttaattgtgtgaattgcataaacacatgcaatcattagagtatagttgctctctcaataagtcttccagatggttctcttcctttccagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggatctgctaattg

SEQ ID NO: 117955 - DNA, 1569 bp, Homo sapiens
  Payload ID: 3072
  Gene Symbol: C10orf128
  Gene Name: chromosome 10 open reading frame 128
  Uniprot ID: Q5T292
  ENST ID: ENST00000374153
  CDS Start-End: 41-430
ccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagaaagctgcaagcctcgaccctcttttccttcaaatccctgcttcagtgtcaccactgcatcatggagggcctatttaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaata

SEQ ID NO: 117956 - DNA, 730 bp, Homo sapiens
  Payload ID: 3072
  Gene Symbol: C10orf128
  Gene Name: chromosome 10 open reading frame 128
  ENST ID: ENST00000453436
  CDS Start-End: 1-348
aggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggcgaaaccacaatttctccaaaagcatctggccagatctgtgcaaattcaccaactacagaaagtgaaaagtttcccaaaatatgcctattaacctcgaggaatgacttctctttttgtcatcaaagtggatgaagttttgtttgccttgggtttggcaggcagaaaacaacttccaggttgagctctcccctttacccagaagccactggccttcagttcctttctatgttgcacaaggaagtggcccaccttgcaggctttgctgatgagcttttatacctgtttaattgtgtgaattgcataaacacatgcaatcattagagtatagttgctctctcaataagtcttccagatggttctcttcctttccagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaa

SEQ ID NO: 117957 - DNA, 614 bp, Homo sapiens
  Payload ID: 3072
  Gene Symbol: C10orf128
  Gene Name: chromosome 10 open reading frame 128
  Uniprot ID: Q5T292
  ENST ID: ENST00000474718
  CDS Start-End: 24-341
ggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtg

SEQ ID NO: 117958 - DNA, 2070 bp, Homo sapiens
  Payload ID: 3072
  Gene Symbol: C10orf128
  Gene Name: chromosome 10 open reading frame 128
  ENST ID: ENST00000374156
  CDS Start-End: 109-540
atctggtcttgctgggccattgctctagaacctgctcagtaattagcacttgtttgagtcaattattgcccgaagtggaacatcagcctctggagccagtctgcaagaatgggacaggtggcgtgccatcctaagaagagaggacagcctctgctgaggccccgggcaagggcagcatggactacaggggttgtgcaagaggggagaatgagagatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggtgagggatgtggtgctcgggcctggctctgccccacccagcgaggcaccgagggccactctgtgatgctggctacagcaagaatgaacccacaagcgcagagcccaacaggctgtaaaggaaggcagtgacctctgcatgtttctgtctctctcactaaccctttgcctctgtttctctttcttctgtctctatctctctctgtctctctatttgtgttcctttttctgtctccctttccatgtctctgtctttctgtgtctctttccctctgtacttttcctttcagttgctcttggcagtcctgagaatcacatttcctggagaaaggtgggagaggaactaaaattggcttcacacagaaatttctgttctctcatccaaatgatgagatcaaataaacccagtcccagtaggcagcgagacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggatctgctaa

SEQ ID NO: 117959 - DNA, 1241 bp, Homo sapiens
  Payload ID: 3073
  Gene Symbol: C10orf131
  Gene Name: chromosome 10 open reading frame 131
  Uniprot ID: A6NCD4
  ENST ID: ENST00000423344
  CDS Start-End: 197-727
gcggtggggcggttggtgatcatcctagcctgcggtagatggtgcgccctgccttccctgcccagacgtaagaaaagtgcactgtccgtccagaaagttgaaataaaaggaccatcatgaaaaaatctcaaagagaagatatttttaaaaaggttgcttccaaatcttggctcttgtgaacagtgctgcaacaaacatgggagtgcagatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagctcattgatagcgaaatacatcaaaggtccaagttgtctccacagactgaagtctcattggatgaaagtctttcatttttcattctgagtggtgaagaaggttcagctttgggcaagtcttcagagcagagaccagtaaaccgtagttatcccaaatgcttttcacttggtgttaatttacaaaatgttgctgagagtgaagaggaagagtttatgaaagaattcattttgacagatatactcaaagtaaaagctgctgactatgaagatgatcaagaacaaataaaaaaacagaaggcaaatatttttgtaccaagtagttctccaggtaacattctttcccagtaaaatattcaagtcattaacgaattatgttatgggataatagctttattgtatgctggataaataaaaaatactgatctaaaattatagtaacttttctatatttgtttttcatgacttccctgaattaagggaactgattaagagaactcattcttcatttaaaaaatgtacatatataggcatatgtatttatatatagagagagagagcgagcgagaaagtaagagacagtgagagagaggctttctgctagacttcagtagtagggtgtaattatagttgtttgtactacttatttggtcaatatccatttaatattttggactttaaagtaatatctaagttttattgttataaagtggttaaccagcgcaaactgccaaaagatatgatgccacgtattctagaagatgaaggattctatattcagagaaagccagaaatatacaaaaagacctgcaacaaaatggaaaatcgcctgcttaaactagaagaggcaagtgcaccacctaac

SEQ ID NO: 117960 - DNA, 446 bp, Homo sapiens
  Payload ID: 3073
  Gene Symbol: C10orf131
  Gene Name: chromosome 10 open reading frame 131
  ENST ID: ENST00000602648
  CDS Start-End: 263-446
gccccgcagcgtcctccccggggacgcccgctcagccgggagctcgcggccggtactcacccgctgggtatactcttcttcttcaccaggacgagagggatgagagacccacgccccaggcaaccccgctctcaggcctcctccagaacagaccccaggaaagttgaaataaaaggaccatcatgaaaaaatctcaaagagaagatatttttaaaaaggttgcttccaaatcttggctcttgtgaacagtgctgcaacaaacatgggagtgcagatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagc

SEQ ID NO: 117961 - DNA, 980 bp, Homo sapiens
  Payload ID: 3073
  Gene Symbol: C10orf131
  Gene Name: chromosome 10 open reading frame 131
  ENST ID: ENST00000618242
  CDS Start-End: 1-531
ctttttttgcagatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagctcattgatagcgaaatacatcaaaggtccaagttgtctccacagactgaagtctcattggatgaaagtctttcatttttcattctgagtggtgaagaaggttcagctttgggcaagtcttcagagcagagaccagtaaaccgtagttatcccaaatgcttttcacttggtgttaatttacaaaatgttgctgagagtgaagaggaagagtttatgaaagaattcattttgacagatatactcaaagtaaaagctgctgactatgaagatgatcaagaacaaataaaaaaacagaaggcaaatatttttgtaccaagtagttctccaggtaacattctttcccagtaaaatattcaagtcattaacgaattatgttatgggataatagctttattgtatgctggataaataaaaaatactgatctaaaattatagtaacttttctatatttgtttttcatgacttccctgaattaagggaactgattaagagaactcattcttcatttaaaaaatgtacatatataggcatatgtatttatatatagagagagagagcgagcgagaaagtaagagacagtgagagagaggctttctgctagacttcagtagtagggtgtaattatagttgtttgtactacttatttggtcaatatccatttaatattttggactttaaagtaatatctaagttttattgttataaagtggttaaccagcgcaaactgccaaaagatatgatgccacgtattctagaagatgaaggattctatattcagagaaagccagaaatataca

SEQ ID NO: 117962 - DNA, 1110 bp, Homo sapiens
  Payload ID: 3074
  Gene Symbol: C10orf142
  Gene Name: chromosome 10 open reading frame 142
  Uniprot ID: B7Z368
  ENST ID: ENST00000619243
  CDS Start-End: 12-404
gagaagacaaaatgaggatgtactcctcagatgctcacgaaaggcctccttccccttctttgggaacgacccccccccaccccctccccccaacaggcagtcccaggccgcgccaggactcggccgcaggcaactcggaggagcgggagcccaggggcctcaggagggcctcgggagtggggagcagctgtaagcgccctacagtttgcatgggaaggcaacagggacttcccttttgcactgtctgcgggtaccgctgttccagccctgagaggacgaggggacgctgcgctgtggggaaagtccgggtggcaggaggtggcggggctcctggaggaggtgctgggatgcgctgctgtggctgcagagaaagaaatataaacaaagagcttgaattattttgaaataactgttggtagctggactgtgttctcttgaccgcaacattgctctgggactgaatcgcgtgggtctctgctcttcctaagtgttacataagaatagcgaacccatgaggtcagcttctaaaccagtttcttcccataacctcctggaccaagtcccaagcaaggcccagaggagctcaaggacccactctccccgggacactcctcgctctctagttggaaggaggaaatgaatgtcccccagtaattgaaggctgctcatgtttgtgtagaaaagccaagcacaggcccatattctagagggttgcttgcggcaggcggaaggccatcgaaggcaaaacgaaacaaatgaaaaggcatcttttgaagctaatggaacagatcaggtggtcaaaaatggataaacaatggcatttggagcaaaactttcagcttcttcgttttagttcgacagccccaggagggcatggaagcttctcgccctcctcatatgtcttgccccaggcatctctgtgtctctctcctctgtaacatcctttatagtaaatgtaagtaggcctttccctgagctctgtgagctgctctagcgaattattcaagtgttaggaggcgtcctgggaacattgattcgtgggaacgccagtgggtcagaagcacaggtaagaccaccttgccattggcattggaagtggagggcaggctt

SEQ ID NO: 117963 - DNA, 1010 bp, Homo sapiens
  Payload ID: 3074
  Gene Symbol: C10orf142
  Gene Name: chromosome 10 open reading frame 142
  ENST ID: ENST00000623589
  CDS Start-End: 193-1005
gcagcatggatgctcaggcaactgacccgtcaggactgcagcaaatgaacagaagctgggggagagcgcgggctggtgctgtacggagctctggcgcagaaggcgctcaccaggggtgcccagagccggggtctgtgcgccgcgggttggatccgggtcacaggctctgggtggacagagtgagaagacaaaatgaggatgtactcctcagatgctcacgaaaggcctccttccccttctttgggaacgacccccccccaccccctccccccaacaggcagtcccaggccgcgccaggactcggccgcaggcaactcggaggagcgggagcccaggggcctcaggagggcctcgggagtggggagctgtaagcgccctacagtttgcatgggaaggcaacagggacttcccttttgcactgtctgcgggtaccgctgttccagccctgagaggacgaggggacgctgcgctgtggggaaagtccgggtggcaggaggtggcggggctcctggaggaggtgctgggatgcgctgctgtggctgcagagaaaggtcccgaggacgcaacccgtcccttcccccgaactgcgaaggagccccgcggggaggacgggcagggtctcccggagggaggaacaggggagcctggagtctcagggttgcggggagcagaggcgttctgggtggtgaacgtccccagcctgccctccctgctcactgcgaggtcgcgcaccggctctgctccaggccttccctcagccctggcctccaggcagtttccatttttgccaggtggattctgtacggcttcatttattcagaatctggatcaacaaatgaacactcagagaggaaaagggtgtttggaggggtggagaggtttccaagcaggtgcccacctgagggccccctgaaaggggacttaaagccgagtttccagctgggccaccctttttttttctttctttctttcagaaatataaacaaagagcttgaattattttgaaataa

SEQ ID NO: 117964 - DNA, 3131 bp, Homo sapiens
  Payload ID: 3075
  Gene Symbol: C10orf2
  Gene Name: chromosome 10 open reading frame 2
  Uniprot ID: Q96RR1
  ENST ID: ENST00000311916
  CDS Start-End: 186-2240
tgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattg

SEQ ID NO: 117965 - DNA, 3175 bp, Homo sapiens
  Payload ID: 3075
  Gene Symbol: C10orf2
  Gene Name: chromosome 10 open reading frame 2
  Uniprot ID: Q96RR1
  ENST ID: ENST00000370228
  CDS Start-End: 186-1934
tgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattg

SEQ ID NO: 117966 - DNA, 1065 bp, Homo sapiens
  Payload ID: 3076
  Gene Symbol: C10orf35
  Gene Name: chromosome 10 open reading frame 35
  Uniprot ID: Q96D05
  ENST ID: ENST00000373279
  CDS Start-End: 160-525
aaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaacaggggccatggtgctcccccagggggtcctggcccccgccagcagcaggcaggtgccaggctgggtgctgctcagtcccccttcaatgacctcaaccggcagctggtgaacatgggctttccgcagtggcatcttggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccaagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatga

SEQ ID NO: 117967 - DNA, 403 bp, Homo sapiens
  Payload ID: 3076
  Gene Symbol: C10orf35
  Gene Name: chromosome 10 open reading frame 35
  ENST ID: ENST00000421716
  CDS Start-End: 94-403
gccagggccagcgggcttcaggagggggacgcgcctgtcccgggctccaggctacgggcaagaccacagggctcctgacctttttcggcatacatgtcaccagtgctatctggaatacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaacaggggccatggtgctcccccagggggtcctggcccccgccagcagcaggcaggtgccaggctgggtgctgctcagt

SEQ ID NO: 117968 - DNA, 799 bp, Homo sapiens
  Payload ID: 3077
  Gene Symbol: C10orf53
  Gene Name: chromosome 10 open reading frame 53
  Uniprot ID: Q8N6V4
  ENST ID: ENST00000374111
  CDS Start-End: 13-294
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataacaaggtgccattcctgactaataacacatagttgccagaagcatctgagattccattgtttagtactcaaagtgctcagaacaggtgaaattaaagagaggttgggggaagagtgggaataaaggcttttgaaagtctgaaccaaaagcaaatgttaatatttggaaaccttgctattcctacagatttatttctgactcctgag

SEQ ID NO: 117969 - DNA, 2130 bp, Homo sapiens
  Payload ID: 3077
  Gene Symbol: C10orf53
  Gene Name: chromosome 10 open reading frame 53
  Uniprot ID: Q8N6V4
  ENST ID: ENST00000374112
  CDS Start-End: 13-486
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggcaagctcaccccaagtagtgacaagaggaccaccagcagctccaggctgacatttcaccagcttagcagcccgtgtaggatgaaagtttctcctttgcaacagttcccacaaaagacccaggacctgacttgtactgtattggcccagattggatcatgtatccatttccaaaccaatctttgtgacctgggttggccaggcctggatcacatgctcatttctggactagagaagaggggaactcagccctactgaaatcgacaggacagattgtgggaaaggggttcatttcacaaaaggaaaatggtgggtctgtttccagaataagggtgaatagatgctgagtcccccaaaacaaaaattgtcccacatctcccgaacctctccagctagatgtcccacaggcaacctgtggcaaacccaacgtgattctccccagctctgagtctctacaactgtattcccgtgttgaagttatgatcgatgaactacttactcaatttgggaacttggggacagcccccaccatcttctgaagtgaactgatctgcccttttctcaacaatgccagtgctttcgccctgctttgggatttggcatctcttccccaagctgtttaactggattcctatctcgttactctgtctccattatctcctcctgcaaaccactcgccacatggctgctaaaatcatctttcccaagcattgatctgcccgtttcttccctgtgcatttattttttggctttccattgtcatgttatatttggggacctctccacactgtgagtcttggtggaaacagagtcttgacatgagcaagtaacccatgctccaccaggggaatgcactggccctagacctcaactctagggcttgtggcaaaaggatggtaagagaaggaatgatgtgttctgtggctctggcagcggcagctacatccagcttctggggtcagccagggcaatcatgccagctacgacatccagcatctagcaaggttaatggggtaagctgccgtttctggcctcggcagcatgaccatgggctccttccaggcctggttttgtggtatgacacggcctgaacctctggcttcagagcctctccttgtgtccctgtattttatccagcctgcttctccagccttctaggccagtccttgagatcctggtttcctctcaaacaattccttttgagcccatctcagccagaaccagctctgttgctcacagctataaaccttgactgagacactcctgtgtggtttcaggagaaaatttaaactcttcagccaggcataagagaccctttacgatctgagcctcactcacctgttccctggcccactgcccaccccacagccctaagtgattagcaaagcaggcctttcacatttacaggcctctgccctcctggcatccccttctccacctggtaaatgctgcccaactcaagcagcaactcctaccataatctttccccttctcccttctctcccagcagaacggtgggctcccctctctggttccctgcagccttgctctgcataggctctgatgaatgcctggcaccctatatctgtgtgtgtgtgtgtgtgtgtgtgtgtctgtgtgtgtgtgtgtgtgtgtgtgtgtctgtgtgtgtgtgtctgtgtgtcttgggagggtcatagagctcctcaaagcagcagcatgtcacctcccccacgccccacgtctttgtgcctcctaccctagagcccaccatagcacttgtcccatagtgagccctcaacaaacacacagttaacaaaggatggcaatcaatgctccatcctgccagccctggacacaacacccaacagttgctcgagggccagtgtggcattcttacttaataaaacatgttggaaaatg

SEQ ID NO: 117970 - DNA, 2415 bp, Homo sapiens
  Payload ID: 3077
  Gene Symbol: C10orf53
  Gene Name: chromosome 10 open reading frame 53
  Uniprot ID: Q8N6V4
  ENST ID: ENST00000374113
  CDS Start-End: 48-329
agcagcgtgtgtttctcccttgcctctgcggcggcggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggtaagccctttggcgatgcttccagccagcaatttgcctcctctgaggagtccctcaatttctagttgaaatgatcagtgtatcatgcctggattcaaattgggtttctttctgagtttgaaacttgtactgaaagccctgtgctttcagtggcacacacaggagagtatccaaaaccacacagtaaagtgtgtgatgctacgagtttccccaaacattggaaacaggaaggaaaatgaagtgaagccctggacttcgagggatgtgatggaattaagggataataggtttttgtactttaataatatgtattctgttattatttgctttcgaagctgctttttttccacttgtttattctatctagacttgctaagacactgagttgatatgccagcagtgcatgacactatcagcaacattcaaatgagagcttctggcctggcaggctggcactgtgcgtgcctctctgtgctcagaagttaaagctttgcaatccactaacactctattaaaaactagttaacattttaccagcccatggcctttgaaaatgcactctgggtggaagccataggtatgtctgatatgataacaaattgtatataaagctaaccaaaagacaattatatctgtttccctaggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataacaaggtgccattcctgactaataacacatagttgccagaagcatctgagattccattgtttagtactcaaagtgctcagaacaggtgaaattaaagagaggttgggggaagagtgggaataaaggcttttgaaagtctgaaccaaaagcaaatgttaatatttggaaaccttgctattcctacagatttatttctgactcctgagggaataaatattttaaattgctattataaaattagccaaaatcaaatcttcaatttctctcatctaaaacaagaaaatgacctgccttcttttgcattaatatcgtctgaggagggcgcaaaagagtcctcagcagaatgtgagatggttccctggtccctctggagtagaacacagccccatagagttaaagagggttttcactatgttcagtgtgaaaatcagtcatgtcgaaatgatatttttactttccactcttacgcaccaatgtgtagtatatattcttaactatagagtaacagagagggggaaatgcagatattgatctaatgacgtcaaatgggaggtcatggtaagaaggcctcacacctacggggagaaaaccagattccctaacagaaaactctggacccggggcacctgtgctgaaggagcagggctttcaggatcgctcagagacctgcggcttcacctgctctgagagcagtcctaaccatcgccccaggcagcctcaaaccctcctgcaccccagaacttcaaagaccactggggaccatgaaactgcttgcacaagttccttctcacacaggacaaagtaggggatataatttttaaaaccccagcccaagcttcacttgtcagagttgattcagggattgtgaatcacttagaactctatggaactatttaagcatctccttactgagaaactgaggctcaaaagagattcttcctcccagtgtctggtgctggttttcacatatcttttgtaaccctacatttagtccctttttttcaaaacccagtttaagttactatagatgtagcattcaatctttgtttcaatataacattttactacaagagaaatccattctcattaaagaaaaatggaaaaatacaggtaaaaataaagtacaactttagtaacattttt

SEQ ID NO: 117971 - DNA, 2090 bp, Homo sapiens
  Payload ID: 3077
  Gene Symbol: C10orf53
  Gene Name: chromosome 10 open reading frame 53
  Uniprot ID: Q8N6V4
  ENST ID: ENST00000535836
  CDS Start-End: 13-486
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggcaagctcaccccaagtagtgacaagaggaccaccagcagctccaggctgacatttcaccagcttagcagcccgtgtaggatgaaagtttctcctttgcaacagttcccacaaaagacccaggacctgacttgtactgtattggcccagattggatcatgtatccatttccaaaccaatctttgtgacctgggttggccaggcctggatcacatgctcatttctggactagagaagaggggaactcagccctactgaaatcgacaggacagattgtgggaaaggggttcatttcacaaaaggaaaatggtgggtctgtttccagaataagggtgaatagatgctgagtcccccaaaacaaaaattgtcccacatctcccgaacctctccagctagatgtcccacaggcaacctgtggcaaacccaacgtgattctccccagctctgagtctctacaactgtattcccgtgttgaagttatgatcgatgaactacttactcaatttgggaacttggggacagcccccaccatcttctgaagtgaactgatctgcccttttctcaacaatgccagtgctttcgccctgctttgggatttggcatctcttccccaagctgtttaactggattcctatctcgttactctgtctccattatctcctcctgcaaaccactcgccacatggctgctaaaatcatctttcccaagcattgatctgcccgtttcttccctgtgcatttattttttggctttccattgtcatgttatatttggggacctctccacactgtgagtcttggtggaaacagagtcttgacatgagcaagtaacccatgctccaccaggggaatgcactggccctagacctcaactctagggcttgtggcaaaaggatggtaagagaaggaatgatgtgttctgtggctctggcagcggcagctacatccagcttctggggtcagccagggcaatcatgccagctacgacatccagcatctagcaaggttaatggggtaagctgccgtttctggcctcggcagcatgaccatgggctccttccaggcctggttttgtggtatgacacggcctgaacctctggcttcagagcctctccttgtgtccctgtattttatccagcctgcttctccagccttctaggccagtccttgagatcctggtttcctctcaaacaattccttttgagcccatctcagccagaaccagctctgttgctcacagctataaaccttgactgagacactcctgtgtggtttcaggagaaaatttaaactcttcagccaggcataagagaccctttacgatctgagcctcactcacctgttccctggcccactgcccaccccacagccctaagtgattagcaaagcaggcctttcacatttacaggcctctgccctcctggcatccccttctccacctggtaaatgctgcccaactcaagcagcaactcctaccataatctttccccttctcccttctctcccagcagaacggtgggctcccctctctggttccctgcagccttgctctgcataggctctgatgaatgcctggcaccctatatctgtgtgtgtgtgtgtgtgtgtgtgtgtgtctgtgtgtcttgggagggtcatagagctcctcaaagcagcagcatgtcacctcccccacgccccacgtctttgtgcctcctaccctagagcccaccatagcacttgtcccatagtgagccctcaacaaacacacagttaacaaaggatggcaatcaatgctccatcctgccagccctggacacaacacccaacagttgctcgagggccagtgtggcattcttacttaataaaacatgttggaaaatg

SEQ ID NO: 117972 - DNA, 4689 bp, Homo sapiens
  Payload ID: 3078
  Gene Symbol: C10orf54
  Gene Name: chromosome 10 open reading frame 54
  Uniprot ID: Q9H7M9
  ENST ID: ENST00000394957
  CDS Start-End: 60-995
ccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgact

SEQ ID NO: 117973 - DNA, 758 bp, Homo sapiens
  Payload ID: 3078
  Gene Symbol: C10orf54
  Gene Name: chromosome 10 open reading frame 54
  ENST ID: ENST00000470317
  CDS Start-End: 1-421
gctacctctgccagcgcctgatcaccttcccaggataagcctggctctggatgacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagcct

SEQ ID NO: 117974 - DNA, 2360 bp, Homo sapiens
  Payload ID: 3079
  Gene Symbol: C10orf55
  Gene Name: chromosome 10 open reading frame 55
  Uniprot ID: Q5SWW7
  ENST ID: ENST00000412307
  CDS Start-End: 198-653
gctgatggagatgactctactgcaaaaatgacaaccagcaagaaagcgggtggtgcccgtttcctccctggggaccctcagagggccaggccattctcttccttggtgtgactgcggatccagggcccagctgaagagcatcagatctgtgggcatgttgcaccagtgaatgttggagaagtacttgttggacacacatgttcctccatttagacagtcacagttcgctggagagaacaaagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtggatggaatccggaggaccccagctccctgagcagcccctcctctcccctggtgctgatcagaggtccttgggcagcatcagtcaaagcaagagcgcactcactttggagtcgctcacgaccaggacgcagagaagcaggcgcgccagcagggctctcatggtggcgaggtcggggcgctagacggcggctctgcaaaggaaggagaagtcagggcaagaggcggaggaacgggaaggcaggccaggcgggcgactgcagcgcaggggagatgcccgcggtgaccaggctccccagctgtctctctcctctctgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccggtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctattgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctcc

SEQ ID NO: 117975 - DNA, 1208 bp, Homo sapiens
  Payload ID: 3080
  Gene Symbol: C10orf62
  Gene Name: chromosome 10 open reading frame 62
  Uniprot ID: Q5T681
  ENST ID: ENST00000370640
  CDS Start-End: 172-843
ccttggggagcctgccctttcaagcatgaatcataccaccagagatcacccagcgtgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcaccagcaggcagaagacatctgggccctcagtgatccaagagatccaccaggagtctggaaaagccccatccactgatgaggccacgtgggccgctgtggctgcctgcaccaaggagattgacacccaggggcggcacctggctcactccatgctgcagcgggccatagcttaccagcactcaggtcacctagagtccaaggacatcaaccaggaggagctgagggccctcgaggaggtagagatgaagctgcaaaagaatttcctcacccagcgggaaaacaccatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttca

SEQ ID NO: 117976 - DNA, 2799 bp, Homo sapiens
  Payload ID: 3081
  Gene Symbol: C10orf67
  Gene Name: chromosome 10 open reading frame 67
  Uniprot ID: Q8IYJ2
  ENST ID: ENST00000323327
  CDS Start-End: 69-626
attttgtccaggaacgcctacgtttgtggcaggtggagacagcttattaggcagcctgctctcctcttatgatggccttggtccgggatcgcagggctcattatgtcatgagcatagttattagatgggttcactgcttttcctcctccttgagggggacctttggcacacgctgggaggccatgaaagccaaggccaccgagctgcgggtctgctgcgcgcgtaggaagcgagaagctcgggaattcaagcccccgcaaatgcgcgggtccacgagacttaacatttcagatgatttaaagattggctttttcagcacagaccatgccactcaaactgattccagtgaaatactgtcagtaaaagaattgagttcatctacgcaaaagttagcacagatgatgaaatccctccaggtagattttgggttcctcaaacaattgcttcagttgaagtttgaggaccgactgaaagaggaatctttgagtctcttcaccattctgcatgacaggatcctagaaattgaaaagcattatcaacagaatgaggataagatgagaaaatccttcaatcagcagttagctgatgccatagctgttatcaaaggaatgtaccagccactgtgaaaccaaacattgagatactctggatgtgctgaaggtagcaaggtggaaagataagaagcagaggggtccttggtaatgtcatggagccatgaaagtaaccctggacttgccctgcctctggcctcttattcatgagataacaacccctcagtgtctaagccactgttagttggcttttcagttacttgcagctgaaaacatcccaggacagattgctctgctaacgatctctgtgactctgtgccaaactgtgtttccaaaggcatctgtgacactgtctcccacttacctgctcttgtgcaatgtttctctcccatcaagaggtggaatctgattcccctcccttgaatcagggctgcccttagtgacttgctgataaacacagaatgtggaggaagtgaagctgcgtgacttttaagttaacgtcaaaagaagtcttgcaagttcatccttattcactctgaatgtttcccctctacattgtccctccctgaattgagctaccatgctgacaaaagcccatgccatatggaagatctacatgtaggtactactgggtctccaggctcatctgagcccagcctttgagtcaccccagcccaggagtcaaaaatatgagtggagaagcgtccagatgactccagctgccagccatgtagactctttttatgtgaggtcacaggtcttacagaggagagataggccatccctgctgtgcttctactaattcccgactcattgaatttgttttttttttttctttgttttgctttttatttttgggtctttttttttttttttttttttttagagacagggatctcactgtctcccaggctggaatgtagggtgtgctcatagctcactgtagccttaaacttctggactcaagtgatcctctggcctcagcctcctgagtagctgggactacaggcatgtaccagcacacccagttaatttaaatatatatatatatatgacatgggatcttgctatgttatccaggctggtcttgaactcctgtcctcaagtaatcctcctgccttagcattccagagtgctaagattacaaccatgagccactgtgctggcctaattaatatttaatggaagaagacggaaggaagaaagagaaagagggaaggagggaaaatgagcattatctgtagcagttttatatatattgattttgtaaccaaaaatcttgctaaattcttgtgtttattttaataagttttctatagactctttggggctttctatgtaaacagttatgcaactgagaataaatattttttgtcacttcatttttcatccataaaccatgtaatcatttcagcagtggcctgtctggagcagctgctgcaaagatgccggctgcagcaggggagatatggccagggctgtacactctactaagctggcaggagccaggaacaagcaggagtggtgctcaccttctgagttggtgatgggggagctccacgctcctagaggcagctgcagctgcccagccatggctgcagacccaggcatccctgtgctcttgggggcctaggaagcccccctgctcccacaggctcggaagtgcctactcctgctgcctggcctctcctcactcctggcacccactctgattttgaagcaaagttgtggccaagcccaggcgctgttatgacccagccaggtgtgtgtgtgcttgggatggtgctgacacaccagccctctgctgccttggccccctccagagtttgggtgccaacaagcatgggagggaggccaagggggcactgagggtggcacagcacaggcctgcaggtgtcccttggcatgaacagcctgggcaccatgaacagcagcaggaagcgacaggctcccgagtggaaagggatgtgtcgctggtgaagctccaccttcaacccaggggtggcctgaagcctgggggccaggctgccagttccacagactggagtgagaacttatggtgcttttttcaggcccacctatggctgcccattgaccaatcagcatgagcttcctcccctctgaagcccataaaaaccctagactcagccagactctggcagaagtggggatgacctgcctgcagagaggagttattcgctgtggggtcttctctcagctaagagctgaacagatatcaggatgacct

SEQ ID NO: 117977 - DNA, 888 bp, Homo sapiens
  Payload ID: 3081
  Gene Symbol: C10orf67
  Gene Name: chromosome 10 open reading frame 67
  ENST ID: ENST00000376500
  CDS Start-End: 1-888
ggccggaagatcatggagggcctcgaggcctctattgaacaattccagttcaaccccagacttaacatttcagatgatttaaagattggctttttcagcacagaccatgccactcaaactgattccagtgaaatactgtcagtaaaagaattgagttcatctacgcaaaagttagcacagatgatgaaatccctccaggtagattttgggttcctcaaacaattgcttcagttgaagtttgaggaccgactgaaagaggaatctttgagtctcttcaccattctgcatgacaggatcctagaaattgaaaagcattatcaacagaatgaggataagatgagaaaatccttcaatcagcagttagctgatgccatagctgttatcaaaggaatgtaccagcaattctttgaggtagaagaagagaatgtttctttgcaagatgcgagtactgtcaaaacaaatattttgttaagaaaactgaaagagaaagaagaagttattaaagaattaaaagaagaactagaccaatataaagattttggatttcacaaaatggaatcttttgccaaagaaaccagctctccaaaatcaaacctagaaaaggaaaatttggagtacaaagtggaaaatgagaggctgcttcagatcatttcagagcttgaagaagaaatccagatcaatctaaaagaaaattcaggattagaagatgaacttataagtatgaaagagatggcagaaaaggatcacaaaactattcaaaagttaatggatagtagagacagattaagagaagagcttcattatgaaaaatcattagttcaggatgtgattaataaacagaaagaggacaaggaaatgagaaaaaagtatggcagcttaagtgtaaag

SEQ ID NO: 117978 - DNA, 5230 bp, Homo sapiens
  Payload ID: 3082
  Gene Symbol: C10orf71
  Gene Name: chromosome 10 open reading frame 71
  Uniprot ID: Q711Q0
  ENST ID: ENST00000374144
  CDS Start-End: 289-4596
aagaacaccatttggtttcccccggctgggtctctatttagatgggcagtgatgacaccaaatataagcataaaaagacgttttaaaactacagatcctgaaacccagcacggcaggcacctgcagcttccagtgctgtaacagagaaaaaaaaaaatccccactttgcaattgcatctggtcaatgagaggctctagttttggggaagagggaaacacctaaccttgacagaatcatcaccagagacacctgccggctgacaaggacagctttcttggagccaacagatgatgcaaggaaataagaagtgcacagacgcgttcagcgactcctccagcatcggcagcgtgttggatgatgcagacagggaggtgagcagcctaacagaccgggcattccggagtttgtgcatctccgaggacacatccttccatgactcctatctggctgtgtccccggatatcacccgacaggtgtttgggacttttcaccagagaacagtgggccacacccagaggaaaagtggcatttggagccagttaccgtcacagggcacggaacattcgggctgggcggccaccttccaacagctacccaagtacgttcagggagaggaaaagtaccccaaaaccagccccccaccaacgccagtccagaggagactggaggtgccagtttccggcctaaggagcagcaataagcctgtctccaaagtatcaacactaattaaatctttcgacaggaccgagagccaacgttgtgagagcaggcccactgccagcaagcctccggctctgaaaaatcctcccaaattcgctcctcttccagaaaacagtgtcaacttctgcttcgattctgcctttctgacagtcaggagggtgcccgctgaagtttccaacacccatcagaacagctaccagccaggcaggaagcacggagaacaggagtcctccaagaatccagaaatggcctgtcacggctccagcagcttcctcccagcagccaatgacacggccaccttatgtgagtcaaagttcccctctccacaccacaagccagtcacgggtgagcctgggagaggcaaaggtacctttctgcacagtgaaaatagtgcttttgagtcatggaatgcccaccaaccaaagctgctggagagaaaggacacagctggaaccgtcccagaaagcaaagctcccaagcactatggggacacgaccttgctaagagaaccctgtcctcctgagcgcacagtctctccctgccaggtccaggccagctgcagtcaggaagagaacagacttgcagcaggggctctgtccacatctataccctgggggtgcagggatccaggagcccaggtatttgctgtggaaggaaaagctcccagctcacaacctgattctcaagagaagccagcccagcccccatggaggaagccaaagactggcaaaaaagggaaagaaagtctacaagatactttagaagaaaagacacagaccaaccagagaggcccacctttgtatacaaaacacaacccccaggaacagttttcagaaaacaatgctcttgacctgcctgtggaacccaatgaacattatgatcccccctttaacatcagtaagctcctgacccccatcatacccagcaagcacgccctggattcagcagacagccagccagcagagcgaaccccatcacccccaggacagctaaacggataccaagagaaggagcccagtgaatgtcagtctcgagacagctacaagtccaaagcccctagcctgctgttcaacctcaaggacgtgcggaagcgtgttaagagcacatacagttcctcacctctcttgaaagtgcttgatgagaaaactagaggtaaggttgatggaaagcaagaacctgtgagcaacggtgtcatcctccccaatgggcttgaggaaagccctccaaatgagctttctaaggagagacccgctgatgaccccactgcatcacacatcaatccccagaaggaccctacagctgaccccagtgagccctctgcagacagctatctaactcttagcacagctccgactatcgccaaagcccccttctatgtcaatggggaggctgctgagagaagcagttatgagaacaaggaggtggaaggagagttggagatgggtcctgccggatccagctggtgtccagactccagggaacaccgccccaggaaacacctctccctgaggctttgcaatagggatcctgagcctggaggggctacagagaaaatgaagacccaccagctagagaatgggctctccagatctgtgtcccaagagacagaacctgagagggaagcaggacttcagaacacacatttgaaccagaaattcttcccagggcccctctctcctgaggaggaagatgtgttttacagtgacagccaatccgattttatgccaagcctcaaaggtaaggccaaattcagcaccagctcttcagatcaatcctttgcctcatttgatgatcagcagaagatgtggtttactgagaaccagcgggaagacaggaggaaggatgtgagtgcaggtgacagtcagaaggatgagaaggagaatgtgatgcggaaggatgagctgcagtactgtgccttaagcaatgggcacgcatgcctggaaaaccgcagccagggggaagcattgcaaagagaaagggaaagtgtgtctggaggaagaaccaggaaggcatcagcagaggaagctaatttcagaggctcttggattggggaaaataagggcacaaccttttcacaggccaaagaccttactccctcaccatcttctgcttcaaacaggcacatgctgtttacgattaaagacaacaccctcagagctacccccgtaattaaacctatcatgctgcctctcctgaggaccatgtccttggaggactccctcagcagtggccacaaagaggaggaattgccaaggccagaatggggtgaggatcctgggttttgtgcccccgaaaaccaggacattcttggtacatcgacacccactaacacacggggcacacgtgtgaagtgcatggccaacgaggtcatggaggaccctgggcaggggtcgagcatggccaggatggaggcctctcagccagccccaaaggggaatttcccatctatgcctctggtgggagagggggaccgggtgaaggcaccaccagatgctgcacctggcctcgtggcaagcaattgcaagagcggttctgcagactcagggaagctggcagccccatggcacatccccaccattgctttacccgagggtgacatagaagaccagccacccccatggcagcccgaaaactgttgggaagagcaaacaccaggtttcaagagtcactttttgtccacacccagagcagggccccctggcagaagactggtccccagtgagagggcgaattcccccaaccccggctcccccggggagagcagtgcctgctcccctgctgccagcaacatttgggaggagtcttcccaggcccctggaggaccagagctgcttcccgaggagcctaatcaagccagcccctgggccagctccagtcctgccagggtcacccggagggaggacctgacccacgccctcgtgtgggagggcggctctgaccccctacttgagctgtcggcagaagacctccggaccctctctccaagaggttcattgctggatgtggccaccagcccagcaggcacctctgggagacttgagcttcctgcacagctagagaggacagcaagcaagccacctgcagtcccacccaaaacagagaaagccctgcggcgggcaaagaagctggcaagtaagaggaggaagacggatcaggctcaggagaagcatggcgagtcacaggagggaaagccctgcccggaggacttggagcagacacagcaaaggccgctgtgccccagagagaggccccgacacaatttccccgtggtccgttccctgccccctcccgtgcaccgccactccgtgtccggcttctcggagcctgtcgggaggcggcccgggggcccccagtccctcacacccctgcccgcgtaccccgccacccagaaggtcctccaggatccgcagtccggggagtactttgtcttcgacttgccactccaggtgaaaatcaagaccttctatgacccagagacgggcaagtatgtcaaggtctccatcccgtcctccgagggggcctccccagagccgcccccaccggacgccctggccgctccctatgtgctgtaccccggcttccagccagtgcccgtgacggccttgatgccgctgcgctgctcctctcagctctccgcgcccaccttcctcaggcagggccctcgtgcctccgcggcccgcgccaggacccagagtgtccacgagtctggactacagctggacccagggcctcacggtgactgcaccccgcactctgcaggccagcgccctcatggtcctccccagagcccaggagaggagggtgtagaagctccaggcctgggcatcatctccactgatgacctagaggactttgccacagaaggcatttcttgagttactgcaggctgtcccccacccccagatgaacccagaggagcttacttccccctcccccaaaacaagcaacacacacacacacacacacacacacacacacacacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggtt

SEQ ID NO: 117979 - DNA, 724 bp, Homo sapiens
  Payload ID: 3083
  Gene Symbol: C10orf76
  Gene Name: chromosome 10 open reading frame 76
  ENST ID: ENST00000311122
  CDS Start-End: 121-717
gggaggtcgggagcgcgcccgtgagcccggagcagcggcagcgtcggtggcgtcgagagcgagcgggcccgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaaggtgaggcataagctgcagatgtgcctgtggatggcagcttctgacagctgttcctggacactatcagcagacaaatgtactcaaagatttggactcagaaagatacagatgattgaatttggccttgcatttagatgtttttatttcacagatttgctttatctgaataaaggaaaattttaaattcaaa

SEQ ID NO: 117980 - DNA, 4119 bp, Homo sapiens
  Payload ID: 3083
  Gene Symbol: C10orf76
  Gene Name: chromosome 10 open reading frame 76
  Uniprot ID: Q5T2E6
  ENST ID: ENST00000370033
  CDS Start-End: 121-2190
gggaggtcgggagcgcgcccgtgagcccggagcagcggcagcgtcggtggcgtcgagagcgagcgggcccgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaagaacttgatggagagtttggattcattgctttgtgcagaaggttctgaaagtctgaagagtttatgtctgaaacttctcctttgcttagtgaccgtgacagataacatcagccagaacactattctcgagtatgtaatgatcaacagcatatttgaagcaattttacagatactttcccatcccccaagtcgtagggagcatgggtatgatgctgtcgtcctcttggctttgctggtgaactatagaaaatatgagtctgtgaatccttatattgtgaagctgtctatcgtggatgatgaggccacactcaatggaatgggacttgtaattgctcaggctttatctgagtacaacaggcagtataaagacaaggaagaagaacaccaaagtggttttttctctgctttaacaaatatggtgggcagcatgttcatagcagatgcccatgagaaaatctcagtacaaaccaatgaggccattcttctggcactttatgaagctgttcatttaaatcgcaacttcatcacagtattagctcagagccatccagaaatgggcttggtgacgacccctgtcagtcctgctcctacaaccccagtcacaccacttgggaccacaccgccttcctctgatgttataagttctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagaggatcaatatgccaatgcatttttgcatgatgacaacatgaattttcgagtaaacttacatagaatgcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggccttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 117981 - DNA, 284 bp, Homo sapiens
  Payload ID: 3083
  Gene Symbol: C10orf76
  Gene Name: chromosome 10 open reading frame 76
  ENST ID: ENST00000456149
  CDS Start-End: 1-284
tctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagagcctatgagacacaggaagaaggcagcagacaagaatcttccctgccgtcctttagtatgtgcagtactggacctgatggtagagtttattgtaacacacatgatgaaggagtttcctatggatctctatat

SEQ ID NO: 117982 - DNA, 994 bp, Homo sapiens
  Payload ID: 3084
  Gene Symbol: C10orf82
  Gene Name: chromosome 10 open reading frame 82
  Uniprot ID: Q8WW14
  ENST ID: ENST00000369210
  CDS Start-End: 56-520
gggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagagtgaggagaaatgtctctttccttcctactaccgttttaaaaaggggatgaaatgtttgcagtggcctttctgcttagctgggccagctccctgcaactcacacggacggttcctctcctagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaagaattttttaactgccgcctgcatcctgagtggttgacggttgcatgtcattaatgataaagaccgttttttgtcatgtgggaataaagaggctgcttctccgca

SEQ ID NO: 117983 - DNA, 852 bp, Homo sapiens
  Payload ID: 3084
  Gene Symbol: C10orf82
  Gene Name: chromosome 10 open reading frame 82
  ENST ID: ENST00000588184
  CDS Start-End: 41-745
gggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagaaatatatggagttagctccacaaaaacttctgctccgtctccaaaagttttgcagcatgaagagctgctgccaaaatatcccgatttttctattccagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaaga

SEQ ID NO: 117984 - DNA, 2482 bp, Homo sapiens
  Payload ID: 3085
  Gene Symbol: C10orf88
  Gene Name: chromosome 10 open reading frame 88
  Uniprot ID: Q9H8K7
  ENST ID: ENST00000481909
  CDS Start-End: 226-1563
cgacctcctccccgcacactttgaacgccgcgcctgaggccagctggcacatgcgcatgcgtgtctctggtgcctgctctccccaccaaagcaagaagcggcgggtacttgaagcggagtgagccggaagtcgctttgcctgcccatttccacgctgtaccggcggaaattcaagcactggaagagaggttccggggctgggctggcctgactgaaggcggcggaatggagacgcggaccgaggacgggggcctcacccgccgccccacgctggcctcttcttgggatgttgcaggcggggccctgacccacagcctcctcctcacccgggccggtctcggccccggtgacttcgactgggaggagctgctggcaccgcctgctccaggtcaggatctggtgattttgaagagaaaccacaacaacaaagatgaaaacccctgcttcctttacctgaggtgtggccctgatggaggtgaagaaatcgcttctattggcattttaagttcagcaagaaatatggaagtgtacttaggagaggagtactgtggaaccagtaggggcaagaatgtttgtactgtcctggatgacagtgaacatgaaaagatcattttgtataaaaaaaatctaaaattggagtcctccacacatgcttgtaaaataaagttgctctcctttggcgaaaggcagtgtgtgttcatcagtaaagttgtggtacacatgagatcagtttttgcaaattcttcaacaagctctcctgctctaggatcaaggatagaccttgacaaggtccaaaccataatggagtccatggggtcaaagttatctcctggagctcagcagttgatggatatggttaggtgtcagcagcggaattgtattcccattggagagcagcttcagtcggtgttgggcaattctggatacaagcatatgattggactacaatcctcatctaccttaggaaccttaaacaagtcgtcctccacaccttttccttttagaactggattgacatctgggaacgtgactgaaaacttacaaacttacattgataaaagtacacaactgcctggtggagagaattctaccaagcttgatgagtgtaaagttatgcctcaaaaccattcctttcttgaaaatgatcttaaaaatgcaatggcctctttcttaccaaagaaagtaagtgacaactcaaatatacccaactccgagttgctgccttttctccagaatttatgtagtcaagttaatcatctccatgtgggaaataagaccgagtgtcaggaaaacatcaccaagcatggtgaacgcattcttggtgttggaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtgtactgcagatatttattacatatttattacaaagccaaaacccaaaaatatttataaaaagcaagtatttaatgtcctttgagggatcattgtcttacacaaagtgacctcagttttcgtttttactacacttgttattttaaatccagtactgtacactgagttaatatgatacagtcaaattatttttgctcacgatatttttcagtcttacagaaatgtatgtatatttgtgttaagagtttaaaatgcttgaggatttctaatacagttcattagtttgtattgtatatgtgtttaagtataatttttatttatacaaagatcttatagtcttagaagtatgaaaaataatgcttaagagtatttgatttttttctttttctaattatcttggaaaattggatacttaagacttggagcctttacttcagattaccagtttacattttgtattgcttgtgtgagataatgaataagatgtgatatttggcatgtgtaaacttagttcactctggggttgttaatattatttgtttcattacagagtagctgtaggtaggaaagtaaacatcagaactagcctagtccttgttacgattagtactttggatttgatttttcctgtaaaacagatgcagtcatcttgtttgacctcagtaaccccagacagtttaagaaaacctctccttttgagctgatacaggttttttccccagaatccttttctggcatgtttattgtatgaaataatgaggctctccatggaaggatgaacacatatgagtcaagggattgcaattctctctgatagacttagttttcagaccttataactattgtatatgcattgaagggtgatatatttgcatataaaaataaatgcacctgctctgggaa

SEQ ID NO: 117985 - DNA, 3076 bp, Homo sapiens
  Payload ID: 3086
  Gene Symbol: C10orf90
  Gene Name: chromosome 10 open reading frame 90
  Uniprot ID: Q96M02
  ENST ID: ENST00000284694
  CDS Start-End: 122-2221
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattatt

SEQ ID NO: 117986 - DNA, 2995 bp, Homo sapiens
  Payload ID: 3086
  Gene Symbol: C10orf90
  Gene Name: chromosome 10 open reading frame 90
  ENST ID: ENST00000356858
  CDS Start-End: 853-2835
gggaagatggccatgtgcaggtggaggcagagattagagaggggctgtcccaagccgagggacacagaggatgccagacaccacgggacactgagaagggcaaggaagggtcctcccctagggccttcagagggagcacggtcctgacacctggatttctggcctccagaactgggaaggagtaaatccctgttgtatccagctgctccctttgtagtcacttttcacagcagcgctgggaacgaacgcaggcaccaatccagcttgggggccatgtggggtagcagcggatcgggacttccttctaagagaagcgatcttgagccgtgtcacgggtgaggagttaggagttagctcagtggggaaaaggtgaaggcagcactcacggtcatcaagccagcccctgtgggaagcaggctgggtttaaggatttctaacctgggctccttgaactcccagggtccccctacatgtgtgcttcaattttgcaccttttcttggggagaaacgaatcccttgcatttgagttttggaggaccatgtggccttcacggtcacaaactggcaatgtcaagaaggtttggcaggaccggctgggagatgaggctggtggggtcaccagcttgattgtgaccttgctgacaccagcagggcagggaggtgaactgacgcaatggagcagagcctttgtctcaggagcaaaccagccttggctttcagttggatgttggaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaaggtaatggcctcgtcaccagcaggtgtgatgtgtgtggtgcacagatgccgaatctcaacttgacatctttgtttcccttttcctctagcaattactggaccagctccttcaaaggaatgcggtctaaccacaggctgccctgctgaccacactacctggacctgggaggacttcgaatgctggataagccattaaacttagcattatcttcatcatgggaaaa

SEQ ID NO: 117987 - DNA, 2107 bp, Homo sapiens
  Payload ID: 3086
  Gene Symbol: C10orf90
  Gene Name: chromosome 10 open reading frame 90
  ENST ID: ENST00000432642
  CDS Start-End: 122-2107
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagtt

SEQ ID NO: 117988 - DNA, 1595 bp, Homo sapiens
  Payload ID: 3086
  Gene Symbol: C10orf90
  Gene Name: chromosome 10 open reading frame 90
  ENST ID: ENST00000424927
  CDS Start-End: 1-728
cttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattattataaaaattcaa

SEQ ID NO: 117989 - DNA, 1025 bp, Homo sapiens
  Payload ID: 3086
  Gene Symbol: C10orf90
  Gene Name: chromosome 10 open reading frame 90
  ENST ID: ENST00000488181
  CDS Start-End: 399-1025
cgcaggggtatgctgcccgctacacagaaacggccgtgcatcggactttccagataaaaacatttagtacagagttgaaaaaccatgtgatggtcatggattttgtgaagagtaactggtttccctcccagagaagagccaaagtttgtatcatccatatgtgtcaaggcttgaagacggctgagcagacagccagcagatatgagatccacagtcgactcttctcatcccccaaagatcattctgcctgggaaagaaatgaaagtctttccaatgcaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtg

SEQ ID NO: 117990 - DNA, 566 bp, Homo sapiens
  Payload ID: 3086
  Gene Symbol: C10orf90
  Gene Name: chromosome 10 open reading frame 90
  ENST ID: ENST00000463082
  CDS Start-End: 147-266
aggctggaaggtggaagcctgactcattctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggtttagagcttgtccctgggcgtgcgctagaaggctgccataagatgatgaaacactccagggactgccctgctgccctgtgactgtggctgccgagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaat

SEQ ID NO: 117991 - DNA, 1012 bp, Homo sapiens
  Payload ID: 3086
  Gene Symbol: C10orf90
  Gene Name: chromosome 10 open reading frame 90
  ENST ID: ENST00000480379
  CDS Start-End: 389-700
gaggacagatgggagaggagcacggctgggggctgaggcccagccggcaaggagagcgtggagtcactgtgaaggaggggctgcggctgcagagacgctcaggatccagggatgggtctttgagcagtgaagaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttc

SEQ ID NO: 117992 - DNA, 888 bp, Homo sapiens
  Payload ID: 3087
  Gene Symbol: C10orf99
  Gene Name: chromosome 10 open reading frame 99
  Uniprot ID: Q6UWK7
  ENST ID: ENST00000372126
  CDS Start-End: 115-360
ctctgcccattgggaaacacctctctatgactctataaatgtccaaggtggccccaagggaggacttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactcaatgcagacaca

SEQ ID NO: 117993 - DNA, 2885 bp, Homo sapiens
  Payload ID: 3088
  Gene Symbol: C11orf1
  Gene Name: chromosome 11 open reading frame 1
  Uniprot ID: Q9H5F2
  ENST ID: ENST00000260276
  CDS Start-End: 338-790
actagttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaatattctttatccctttttttgttgttgttttaaccaagatttaaatgtcaaatttaatacagcaactcagttctacatttggggtgttgtagaagggccttaaaaagaattattttaggccaggcacggtggctcatgcctgtaatcccagcactttgggaggccgaggcaggtggatcacgtgaggtcaggagttcgagaccagcctgaccaacatggtgaaacactgtctctactaaaaacacaaaaattagctgagcatggtggctcacgcctgtaatcccagctactcaggaggctgaggcaggggaatcgcttgaacctgagaagtggaggttgtggtgagctgagatcatgccactgcactttagcctgggtgacagagcgagactctgtctcaaaaaaaaaaaaaaaaaaagaattatttctctgaagtctacaaccactgtggtcttcccttccttctgtcgtagcaagacctcagaatctagcataacttaggctaggtttggctagatgctttctgggtataagccagagtcgtatagtgcaactttgctgtgaccttagtgaacatcccctcttgaggactacaaaaacaaacgtaactttttaaaattattatggagaattttacgtaaaacaaaagtagacaggctagtctaatgaactcccatgtatcattacccagcatcaactatttatgactaatcttacctacttctactttgtcttattgaattaattttggagcagatcttagaaatagaatttaatctataaaaatcttggtgggctgggtgcggtggctcatgcctgtaatcccagcactttgggaggctgaggtgggtggatcacctgaggtcaggagtccaagaccagcctggccaatgtggtgaaactccatctcttctaaaaatacaaaaattagctggtcttggtggcgggcgcctgtaatcccagctacttgggaggctgaggcaggagaattgcttgaacccaggaagcagaggttgcagtgagctgagacggtgccattgctctccagcctgggcgacaagagcgaaactccgtctcaaaaaaaaaaaagaaaagaaaaagaaaaaaaaaatcttggtatactggctgggcacagtggctcacacctaatcccagcactttgggaggctgaggcaggaggatagcttgaggctgggagttcaaaaccagcctgggcaacatagcaagaccccatctctaccaaaaaaaatttttttaaagatttcagtatatttctcaaaaagataaggactgtcaattgtctactcccccccaacaaaggtcactaaggaaacctgttgactaaacaaagctcattaaacctattgtagtgtagcaaaggagaccatcaacttgacacagagtcttggtaatgattcaaagggaggatgttagagtaaggtatttataaggatttgagataagggtccaactggtttaaaatgagtcaaaatagggaactagtagagactgagaaagggttgtgaatagcttaggtttggtaaacttaggaaatcaacagtcttaattttaatatggttaaactgattagtatttcctatttttttatctactgtgtaagaagacactataatatatgggcattactgagagatactgcccatatgttgtcctcgtaagcaaggagatattttttatctcccatatattacctctcaaacctttgttactttagtttcgagatatagatccagaatttatgttgttactcagtagtgaggaagtttcttttttttttctaaatggctatcaagttgtcccaccattagttattgaaaagaccataattttttcactcctattcaatgccatttttattgtaaataaactatgtacatgta

SEQ ID NO: 117994 - DNA, 1437 bp, Homo sapiens
  Payload ID: 3088
  Gene Symbol: C11orf1
  Gene Name: chromosome 11 open reading frame 1
  ENST ID: ENST00000529270
  CDS Start-End: 676-1248
gtctcttggggtctggatcaggaccccttccggtaacaagaacatgctgtatttggttctctgttctgttgtaagccattttaacagactgaatcttactctgaaaacggtggaaagccactgaaagattttaaataagaagatgatacaattatactttcactttgaaaaattctcctttcctgtggagaaaggtttggagaggaacaaggctgatggcatggcaggataaaacaagaggcaactgcaataatggagacaaagctgacagtgatttgaattgaaatttggcaatgggaatggagggtggcagtctgattcaaaaatcaacaagacttagtgactggatgaaaattaaagacaagtcagagtcaaagataagccccaggcttctggcttggacaactgagtggatggtgatgtctgtcattccagccctagagacagttacacctagatctccagtatgagtaccaggcccattggactttgtggcaccagctactctggtcatcatgttgtttggtaacatcagtgcatgcatctgtcttcacaaaggcagatggtatgagggtagttacctgggatgtcatccttcaatgctgcattattggctttgtttctgcctgtggaaaggcaagtgggtggtgactcccaaatcatggccacttgcccatggtaatctgggtgattctttctttgcttggagaactgggaaagccaggtttgttgacatctttaaagaacatggaacagccaagtaaggatttctgtgactctcataagaaatcttcaaagagctcaacctactcagcatcaagttactcttcttcaggaaagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacaca

SEQ ID NO: 117995 - DNA, 509 bp, Homo sapiens
  Payload ID: 3088
  Gene Symbol: C11orf1
  Gene Name: chromosome 11 open reading frame 1
  ENST ID: ENST00000530799
  CDS Start-End: 84-509
atggctgcctcccagtgtctctgctgctcaaaatttctcttccagaactgggaaagccaggtttgttgacatctttaaagaacatggaacagccaagtaaggatttctgtgactctcataagaaatcttcaaagagctcaacctactcagcatcaagttactcttcttcaggaaagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacat

SEQ ID NO: 117996 - DNA, 534 bp, Homo sapiens
  Payload ID: 3088
  Gene Symbol: C11orf1
  Gene Name: chromosome 11 open reading frame 1
  ENST ID: ENST00000528125
  CDS Start-End: 200-514
gtttcgcagaggggcgggctcgctacctcgctcgcgcaggcactgcagattctcccaggccagtggatcccgagccaactcggccgggcgctggaggcaggtggcgagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatg

SEQ ID NO: 117997 - DNA, 599 bp, Homo sapiens
  Payload ID: 3088
  Gene Symbol: C11orf1
  Gene Name: chromosome 11 open reading frame 1
  ENST ID: ENST00000530214
  CDS Start-End: 20-385
ttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccaggatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaa

SEQ ID NO: 117998 - DNA, 1908 bp, Homo sapiens
  Payload ID: 3089
  Gene Symbol: C11orf16
  Gene Name: chromosome 11 open reading frame 16
  Uniprot ID: Q9NQ32
  ENST ID: ENST00000326053
  CDS Start-End: 108-1511
aaccaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaagacggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccttgggaagccaggaacaagatattccaacatctgcaaagaagaaaaggatcacaaacagcagagagcacaaactgcagtagtggggactaccaaggagctggtctcgaaagcaacccacatgaagccaccgcggaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttca

SEQ ID NO: 117999 - DNA, 1685 bp, Homo sapiens
  Payload ID: 3089
  Gene Symbol: C11orf16
  Gene Name: chromosome 11 open reading frame 16
  Uniprot ID: Q9NQ32
  ENST ID: ENST00000525780
  CDS Start-End: 107-1321
accaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaagacggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccttgggaagccaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttca

SEQ ID NO: 118000 - DNA, 593 bp, Homo sapiens
  Payload ID: 3089
  Gene Symbol: C11orf16
  Gene Name: chromosome 11 open reading frame 16
  ENST ID: ENST00000528830
  CDS Start-End: 69-455
gtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagggcagtgctgagggcagctctgtggccacaatcgctccttgcctacatgagcctcataggtgaacaaccatcctgttggtcttggacacatccctggttggtcttggacacaggagcgacgcttcttgggggtgctggaaggaggagattgcattgagaaaaggtccagggaggacccagctggagagacagggggtcctg

SEQ ID NO: 118001 - DNA, 2956 bp, Homo sapiens
  Payload ID: 3090
  Gene Symbol: C11orf21
  Gene Name: chromosome 11 open reading frame 21
  Uniprot ID: Q9P2W6
  ENST ID: ENST00000381153
  CDS Start-End: 253-651
aggaggtaggctgcatccgcccctctgtctgtctgtcaacatcgccctaggaccgagctgctgggtgccccggaagaagggcaggcaggaaggggaggggcagtgaggttggctccccccaccacctcaccctggtgcccccagcccagcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggagcgctgtgcccaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcagggcccccctgtgtccccagtgaggggtctcgggagctgtgtgtcctactcagggccatccctgcagcccatgctctctgggtgaccagttgccagcagtgtcccccctgccttgggcggaggctgaggaccccagggtgggagggaaggtgcggtgggggctcagccaatgctgcccagcctgagggtccctcacatgtgggccgcacccctgcgtcagccggagtgatctctgcttagggtggtttgaggtgagttctgatatctcaaacaccagcatcagggccagggcagacaaaataagagtgagctggtcaggggtgtcccagttgggagctcgctcacagtctttaaggaggcagggcacagcccagtgggggtggccacgaggccccgggcctgtggctgagatggcaactggcaccggcagtgattggaacagtccagcccatggagccctgtggccttggccggtggctcacggtgccacgggagctggagcaatgggtggcctcccttgcctggtgcctgagtgaaggaggactgggtgcccctgaggaaggaccttgccatactcctacaaatttacattattcttctttccccagtctcccctcagggacctgcagccatttgctggggtggctagtggaaagggggatcatcagactcagggggattactggactctaactctaacctgacacccactcctggggacacaaacacccatcggatctaatagtcagaggaggggcgtatggaggtcagtgggctcacggagttctagctcaggtccaaccctcggtgggtgcagaggtcacttccctagcctcagatgggtgagtaaacagacgtatgtggcagccagcagagcccccacatttgttccctgacctgagggtgggggctactatgctgggaaaggccaggtggaagccattggggtgaactctgcctaggaaaattgtcagtcaaaagcaacctgcagccctggagggactgcaaaggtcagtgccgccatcgaggacttggaagatgcagggtggtgacccccactgcagcctcgttccactcgtctaattggcttgtgtggaagacaggggggtcccggagaaagaaggacagtgaatcctggtaaacttaaccaggactccaattgcaactgctgttccagatatgactactgatcactggggcaaatcaaagcatccccggacacctggtctacagccattgatctggtgaaagctttaatttttaatatagattttattttttagagcagtttcatgtttacagagaaattgagcatatttgagagtcctcatatagcatctctccctacacacagtttcccttattattcatatcttgaattactgtgatacatctttgcaattgatgaaccaatattgacctagtcattgatcaggttacatgagggttcactcttcttgttgtacatgctgtgagttcgggcaaatgtgtaatggcatatctccactattacagtgtcacacagaatt

SEQ ID NO: 118002 - DNA, 1366 bp, Homo sapiens
  Payload ID: 3090
  Gene Symbol: C11orf21
  Gene Name: chromosome 11 open reading frame 21
  ENST ID: ENST00000456145
  CDS Start-End: 53-589
agcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggagaattgtctctctccaaccttgacctccctggagctggtgaggcgggcctggagcaccacccgcttctgggacacctcttcatcagcgctgtgcccaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcag

SEQ ID NO: 118003 - DNA, 2063 bp, Homo sapiens
  Payload ID: 3091
  Gene Symbol: C11orf24
  Gene Name: chromosome 11 open reading frame 24
  Uniprot ID: Q96F05
  ENST ID: ENST00000304271
  CDS Start-End: 404-1753
cccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccacaa

SEQ ID NO: 118004 - DNA, 980 bp, Homo sapiens
  Payload ID: 3091
  Gene Symbol: C11orf24
  Gene Name: chromosome 11 open reading frame 24
  ENST ID: ENST00000533310
  CDS Start-End: 600-944
gttgcgctgccggccacgtccccgcgccgggcctcaggctccttcctactgtccgagggccaccaggccgccgggggcctgctgcgcccgggtaaggggctcgcactgccgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgcaagacgctgagcaatgcagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgcctatgagagctacaagaagaaggactacacccaggtggactacttaatcaacgggatgtatgcggactcagaaatgtgaggggggcgggggcctggcgggaggcctggccccttc

SEQ ID NO: 118005 - DNA, 533 bp, Homo sapiens
  Payload ID: 3091
  Gene Symbol: C11orf24
  Gene Name: chromosome 11 open reading frame 24
  ENST ID: ENST00000527280
  CDS Start-End: 458-533
tgggcggggcccgggcagggcgcgctgcccggagctgcctgggttgcgctgccggccacgtccccgcgccgggcctcaggctccttcctactgtccgagggccaccaggccgccgggggcctgctgcgcccgggaatgtggactttttttcaaactctagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccac

SEQ ID NO: 118006 - DNA, 5508 bp, Homo sapiens
  Payload ID: 3092
  Gene Symbol: C11orf30
  Gene Name: chromosome 11 open reading frame 30
  Uniprot ID: Q7Z589
  ENST ID: ENST00000334736
  CDS Start-End: 144-4112
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtg

SEQ ID NO: 118007 - DNA, 4015 bp, Homo sapiens
  Payload ID: 3092
  Gene Symbol: C11orf30
  Gene Name: chromosome 11 open reading frame 30
  ENST ID: ENST00000524490
  CDS Start-End: 144-3818
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtactttttt

SEQ ID NO: 118008 - DNA, 4074 bp, Homo sapiens
  Payload ID: 3092
  Gene Symbol: C11orf30
  Gene Name: chromosome 11 open reading frame 30
  Uniprot ID: Q7Z589
  ENST ID: ENST00000525919
  CDS Start-End: 40-4011
ggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttg

SEQ ID NO: 118009 - DNA, 653 bp, Homo sapiens
  Payload ID: 3092
  Gene Symbol: C11orf30
  Gene Name: chromosome 11 open reading frame 30
  ENST ID: ENST00000524451
  CDS Start-End: 1-653
ggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtc

SEQ ID NO: 118010 - DNA, 6848 bp, Homo sapiens
  Payload ID: 3092
  Gene Symbol: C11orf30
  Gene Name: chromosome 11 open reading frame 30
  Uniprot ID: Q7Z589
  ENST ID: ENST00000529032
  CDS Start-End: 1-3969
atgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataatatgtggtcttttgtgacttctttcacttagcgtattttcaaggttcatccgtgttgtagaatgtgtcagtactacatttctttttatggccattccattgtgtgaaatatatcacattttgttta

SEQ ID NO: 118011 - DNA, 4116 bp, Homo sapiens
  Payload ID: 3092
  Gene Symbol: C11orf30
  Gene Name: chromosome 11 open reading frame 30
  Uniprot ID: Q7Z589
  ENST ID: ENST00000524767
  CDS Start-End: 40-4053
ggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataaaatgaatttatccttatatttgggtgaaagaccaagttacagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttg

SEQ ID NO: 118012 - DNA, 3798 bp, Homo sapiens
  Payload ID: 3092
  Gene Symbol: C11orf30
  Gene Name: chromosome 11 open reading frame 30
  Uniprot ID: Q7Z589
  ENST ID: ENST00000533248
  CDS Start-End: 40-3735
ggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataaaatgaatttatccttatatttgggtgaaagaccaagttacagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttg

SEQ ID NO: 118013 - DNA, 840 bp, Homo sapiens
  Payload ID: 3092
  Gene Symbol: C11orf30
  Gene Name: chromosome 11 open reading frame 30
  ENST ID: ENST00000531998
  CDS Start-End: 1-324
atcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggtaggtatatctgaaatatgttaaaggtataggtggccttcattgagaggaaaaaaaaaacttacttcattgaaggattatatttgatctcaattttttgcttagaaatctaaagctttgttttagtccttatgtttcatgattaaataaagtttttagttttaatattcaatattcacatataaagcttttgatagttttaaaatggaaagaacctttagttgcttttagtcagagtggaaagattatagtttaaatttgcatagagatttttcatttgcaaagtatccttctatttgtcaacctattcagaccccataacaactctgaggtggttgctattgtgctgaatttacaaatgaagatagatttggctttagagagatcaaattgacctgtccaagaccaattagagttagaaagtggaagaactcttatttgttctgaatatgttttagggaacatatctcataatttcaattactgatgtcactttagtttattaaaaataaaaatatttgaatacttta

SEQ ID NO: 118014 - DNA, 452 bp, Homo sapiens
  Payload ID: 3092
  Gene Symbol: C11orf30
  Gene Name: chromosome 11 open reading frame 30
  ENST ID: ENST00000533972
  CDS Start-End: 125-452
agaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattgggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcatta

SEQ ID NO: 118015 - DNA, 934 bp, Homo sapiens
  Payload ID: 3092
  Gene Symbol: C11orf30
  Gene Name: chromosome 11 open reading frame 30
  Uniprot ID: Q7Z589
  ENST ID: ENST00000533988
  CDS Start-End: 147-395
cctgtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataagtaagccattagtcgtaccatccctgattttttatgacatagtataacacagttttgaaacagtcttcctattgtgtagcagattcctgagtcttttaagtaacaatatctctatactcagggatcctgatcatagcagtaaaagtgatattaactgtttattcagttgggtttttttttgcatttggttaggcaagctttaagtactcaggtcaaatcctgttacaatgtaatctctgtctaactaaaaatcaccacaatttagcagatgattcacttacttgaggccaagttcagtaacaaagtattgtgacccctaaaattgaaagccctttagaggttctttgtaatggtatttgatatgttattaccttataaataggcgttgtaacttttttgatatctgactcattatttcatgtattttgagattcagaaaaaaatgtaaaatttgtgttctgtctttaagaaatatgaatataacatctcttaatttatttttaaaaagccaaaaaaataaaacgattaaagattcttaccaaa

SEQ ID NO: 118016 - DNA, 478 bp, Homo sapiens
  Payload ID: 3092
  Gene Symbol: C11orf30
  Gene Name: chromosome 11 open reading frame 30
  ENST ID: ENST00000531793
  CDS Start-End: 1-478
agaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggtcaagactaaagaattactgagtccaggctaccccttagaagttgtattttatctccctctctccttgcaaggctattcctcagtatgctattccttgtcactccagctccaatgtggtggtggagc

SEQ ID NO: 118017 - DNA, 1105 bp, Homo sapiens
  Payload ID: 3092
  Gene Symbol: C11orf30
  Gene Name: chromosome 11 open reading frame 30
  ENST ID: ENST00000532719
  CDS Start-End: 1-888
cagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaa

SEQ ID NO: 118018 - DNA, 4376 bp, Homo sapiens
  Payload ID: 3092
  Gene Symbol: C11orf30
  Gene Name: chromosome 11 open reading frame 30
  Uniprot ID: Q7Z589
  ENST ID: ENST00000525038
  CDS Start-End: 40-4011
ggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataaaatgaatttatccttatatttgggtgaaagaccaagttacagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaa

SEQ ID NO: 118019 - DNA, 833 bp, Homo sapiens
  Payload ID: 3093
  Gene Symbol: C11orf31
  Gene Name: chromosome 11 open reading frame 31
  Uniprot ID: Q8IZQ5
  ENST ID: ENST00000388857
  CDS Start-End: 25-393
attctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaagga

SEQ ID NO: 118020 - DNA, 818 bp, Homo sapiens
  Payload ID: 3093
  Gene Symbol: C11orf31
  Gene Name: chromosome 11 open reading frame 31
  Uniprot ID: Q8IZQ5
  ENST ID: ENST00000534355
  CDS Start-End: 244-612
gtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagta

SEQ ID NO: 118021 - DNA, 469 bp, Homo sapiens
  Payload ID: 3093
  Gene Symbol: C11orf31
  Gene Name: chromosome 11 open reading frame 31
  ENST ID: ENST00000528798
  CDS Start-End: 1-283
gggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttggctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagta

SEQ ID NO: 118022 - DNA, 1291 bp, Homo sapiens
  Payload ID: 3093
  Gene Symbol: C11orf31
  Gene Name: chromosome 11 open reading frame 31
  ENST ID: ENST00000622257
  CDS Start-End: 347-712
aaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagccgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttg

SEQ ID NO: 118023 - DNA, 654 bp, Homo sapiens
  Payload ID: 3094
  Gene Symbol: C11orf40
  Gene Name: chromosome 11 open reading frame 40
  Uniprot ID: Q8WZ69
  ENST ID: ENST00000307616
  CDS Start-End: 1-654
atggctctagtgcaggcgctggtgcccagagaaagagagccaaagctgtccattttgcagatggacagaggggacccacaacacagctcacactggtgcccagagagagaaaaagttaagctgctgaccctgaagccaagggaaacatccaaaaatatccttataaacttctacagagcctttaacttagataaggatgtgttcatacaccaggccaaccacccactaacagtgccgtctagtgtggtgatgggtgataacggccacaccttggcagaagatgacaaaagaccttgctttagggtactaccttgctatctggaacgtgtttccagtggaatctctatttcctggatctcagcccctctacctgtgggagcaatgaaacaccagcttctatgtgacttaatggatcttatcacgctttctttctggttagcaggtcagtgtatgagccttaaagctaccaacatgcaacactgcaagtgttcaatagccacaagtgactgggccattgaattggaccgcactgattacaaaacacttccatcagaatattccatcctagcactgctccaggtctttgcagggaaaaactgtatggatcgtgttctacttcatgtggatgtgaactacttgaagtccctgccctga

SEQ ID NO: 118024 - DNA, 1142 bp, Homo sapiens
  Payload ID: 3095
  Gene Symbol: C11orf42
  Gene Name: chromosome 11 open reading frame 42
  Uniprot ID: Q8N5U0
  ENST ID: ENST00000316375
  CDS Start-End: 51-1052
ggggttcctgcagcagccactgccctgcccaatccctcccataccccaccatgttggtgggtacccccaacctgctgacactggatgaagctgatgccacctggaccctcatcaaggataaggtcatcgaggagcactttgggcccaatgcagtagcagtacctttcctgtcagatgcagcctgctatgacctactgggtgtgctggtaaaacagtcccgcccagcccatacccgcctggctttgccaggtcggcagggccggagggcactgaaaccagtggggccactaccaagcctcctggagcaggcaggatctgagggtgccttcgcccactgcactcgggaatactcaccaaatggccgagcagagagagcctatgaagagacgcgaatgttggatggacagccctgcaagatccgcctacatatgggtgacctgcgcaagaaggttgccttcctgttgctgccaccagggcaggtgagcctacagcagactcttccctggctccgaagcacccacagcatctatgtcatctaccaggtcttctcttgttcctggctgcagctggggctgacgtctacagcccgtgagccccagctcctccggctacttcggtcattacctgttgccttctcctgcctcaagttttcactgcagtctaagggcgtgctgggaccacagaagcctctcactaaagacccattgccccatggggccaactgggtcagacccaacctcagcatcatgccgcctctggcccccacatcagcacctgctgatacaactgaagctgctgatgtgcccccacctgtcccagccccacctacgccacctccccaggaagggccagaggacaaacccaccagattctcctacaagggccgaaaccccttctggagggggccccagatactgtcagagaactggctcttcagcccccgcagccctccaccaggagcccagggtgggggccccagggaccccgacgggcactccatgtccctgcccctgctgcagggtctatcctcagagttcgacagtgacgactgaagctgaagcaaaagattccgggggcaaagcccccaagatctggcataggggtactggtctctaataaacatcagctgctgctcccccaaa

SEQ ID NO: 118025 - DNA, 3624 bp, Homo sapiens
  Payload ID: 3096
  Gene Symbol: C11orf45
  Gene Name: chromosome 11 open reading frame 45
  Uniprot ID: Q8TAV5
  ENST ID: ENST00000310799
  CDS Start-End: 195-632
cccacgcctaaggtccaggtcccagggctttcccttgcaccttcatccctggccctgcagaggcctgcttctcgcttccggggtcgccagagcgcccctcccgccaccccgccatctcttggccggatcgtgcgagagaaggggaggaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactagccctgtctccttgccaatagccctgtgctccccagccccctcccccatgcagacggctgctatgacatccctgttccttaaagtgcggggttcctcgctgccttctcctccctaactggcaccctgtgcaaacctgctgcagagaacagtgtcttgggcagtgcgatagtcctccagttcaccaacagtaaaaatggtctcaatggggagagatgtctgactgcaagcgctgagtccttccagaggagggctggagggacaggagggcggatcaggtggcctcctgagctggttcctggcgccgatgtaatggatgctgattaccagcggtgagggcatcgtggaagggactgcagaggtgtgcgagatgagtggaatgaggccccaggtgctgatttttatgcccaggatgctcctggctgtcatgggctcccaggggctccaggcatgcacagctcttccgcctcttctcgaagcagaatgccccagaaagggcacctttactatccagggtggctagagtcgccggtggctgtgcgtgggggctgagggctagaatcagggcaaggggctttcagtgaaacgcagagccaggcagggacagcgcggatctcagaacagtctttgtcagatgggacacttcatccccgcggagctgtccgtgcacacagcgttctctgattgccaagctgttaagcactctgcggaagggagctgctgggaaggcggacgaggcatctcaggtgggtgaggggctccgctgcatcagcgttgctcagacccaccatccctggggagctgtcactgacgcccaggtttccccttctcagtacatcctgtgcctcctttctgggctgcctcagtccctcaaaggggagctccccacatgggtgggattattgttgagaacagtcagggtgttgacgaggatgcaggactgaggttgctcccagagtcactcagtgtccctcgttttgctcggagacatcctgacctgggcaagctctttagggagcatctttcctgtctgtgccgcattctccatggcctttgcactctttttgcttttgttttaaacacgtcatcaattcattgcctgcagcagcttgtactgccttttggtttttctttgcagaacagctctggaagtgaagtgtgtgtgtgtgtgtttgcgtgcactactctggactgggtgccttacacgtgttaacacacttgatcagctcagcaacactgtggaataagtgtaatgtgtccattattcagatcaggagactgagattcagagcagggagggaacttgccagagaccacatggcttgcaagcagcagaacctgggtttgaactgacagcggcctgacttcagaacccacgctttcccaccctcctacttcacacccatttgagtccagccatcttggttctgaatcataaccctgactctcctggccacatcctatgctccacattacatgttactctacaggttaccaccctgggtctctttcctatataagaaatagaaatatttgtggaaatcctaatgttcatgacatctctgccattttatcaggaaaaattctatcctaccaaatactggtataatgtacttggcccccctggattggattggtataggttaagagcagatataaggtctgaaataatcccggtattcctagtatgtggaattattatcatggaatcataatggcagtttgcacctctgttgggctctttcaactcctgtgttggctcaggagaatcctatcacattagtccccttttgtagttggatagttgggcttgccagaaggcacacaaatttgggttaactcatttccaggattctggcattgtagacacagaaacaccgactgtgaagttttatgtaatacaaacactgggagatttagcaataggcctgccaggcggccctggcttctggctgcacaacaaaggggggtggctggtgctgaatggggcaacagaaggtgagtttggggcctgcagagcctcgggtagcccagaggagcgagagagtattggctgttcattttaactccatccttggaggattccccaccacaagcctaaggaagtaataaaacctcatgcattattttttgatatctggagagaaacacgtaccctagaaatgctgtggactaattccatggttactttgtcattaaagaaaccaaaatactgagaggtcaccataaacacaaaaaggcagagagagaaggattaaatggtgtttcatgtaaggatctttaaagggagacagaattctagtctgaaaggagcgcaggcagatctggcattttgcttggggagttcaattctttggagaaaatacagagacaaaaagaccattttgatggtatttaaaatatccctctgcccagtgtatctaagtgagtctaaatatattcagcaattttttaaagggcagatattaggcccgattcaaggtatggaatatagattcgaaagggttagtgataggtgagtgcctttcaggtagctttgcatcacagaccaagcccattattgaggactgtacgtatggagcaggcccgtgagcttgtgactgagtttcccaacctgccaggctcccatttgcttaggatgaatatttttctgccctccctggtgagccactgtgggccactcgccactccttacaccccttccctttaatacctcgcttggcttacttgcaaaatccacatgcatcctcctggatctcacagaagatgtatgaaaagtcatggccatgaaaagggcacggaaatcaaattaattaattttgctttttccccacgtttgtttctgtctgtctggtacttttcctttttaagcctgccatctctttgaaagtgagccgcacagtgataatccattttcttcattgtaaccccacagtgtatgtattccacattaaataataaaagggattaataattaaatcaaaatgaaaaacca

SEQ ID NO: 118026 - DNA, 609 bp, Homo sapiens
  Payload ID: 3096
  Gene Symbol: C11orf45
  Gene Name: chromosome 11 open reading frame 45
  Uniprot ID: Q8TAV5
  ENST ID: ENST00000524878
  CDS Start-End: 172-609
gtgcttcaaacgccttgaggataaggaaggagaatcagcaagtcccgagttcctacggtgtgtcagcatcgtgctcccactcccgggagagaggcattatcttcagtttacaaaaggggaaaacaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactag

SEQ ID NO: 118027 - DNA, 1645 bp, Homo sapiens
  Payload ID: 3097
  Gene Symbol: C11orf49
  Gene Name: chromosome 11 open reading frame 49
  Uniprot ID: Q9H6J7
  ENST ID: ENST00000278460
  CDS Start-End: 60-1055
cggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaa

SEQ ID NO: 118028 - DNA, 1651 bp, Homo sapiens
  Payload ID: 3097
  Gene Symbol: C11orf49
  Gene Name: chromosome 11 open reading frame 49
  Uniprot ID: Q9H6J7
  ENST ID: ENST00000378615
  CDS Start-End: 29-1042
ggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 118029 - DNA, 1166 bp, Homo sapiens
  Payload ID: 3097
  Gene Symbol: C11orf49
  Gene Name: chromosome 11 open reading frame 49
  Uniprot ID: Q9H6J7
  ENST ID: ENST00000378618
  CDS Start-End: 53-1033
ctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaaagaaa

SEQ ID NO: 118030 - DNA, 1916 bp, Homo sapiens
  Payload ID: 3097
  Gene Symbol: C11orf49
  Gene Name: chromosome 11 open reading frame 49
  Uniprot ID: Q9H6J7
  ENST ID: ENST00000395460
  CDS Start-End: 39-863
ccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 118031 - DNA, 560 bp, Homo sapiens
  Payload ID: 3097
  Gene Symbol: C11orf49
  Gene Name: chromosome 11 open reading frame 49
  ENST ID: ENST00000525279
  CDS Start-End: 77-226
atggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataaagctggacctcctgaactgtgtgacctacttcagtggtacctcaggttctacatgttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgcctt

SEQ ID NO: 118032 - DNA, 1527 bp, Homo sapiens
  Payload ID: 3097
  Gene Symbol: C11orf49
  Gene Name: chromosome 11 open reading frame 49
  ENST ID: ENST00000525895
  CDS Start-End: 28-213
gagctttgaagccaccccggtcaaaggatgctgagtccggagcgcctagccctaccggactacgagtatctggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggt

SEQ ID NO: 118033 - DNA, 626 bp, Homo sapiens
  Payload ID: 3097
  Gene Symbol: C11orf49
  Gene Name: chromosome 11 open reading frame 49
  ENST ID: ENST00000534249
  CDS Start-End: 1-205
ccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccagattctctctttccccttcaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggct

SEQ ID NO: 118034 - DNA, 714 bp, Homo sapiens
  Payload ID: 3097
  Gene Symbol: C11orf49
  Gene Name: chromosome 11 open reading frame 49
  ENST ID: ENST00000526827
  CDS Start-End: 1-582
agggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcgcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagc

SEQ ID NO: 118035 - DNA, 556 bp, Homo sapiens
  Payload ID: 3097
  Gene Symbol: C11orf49
  Gene Name: chromosome 11 open reading frame 49
  ENST ID: ENST00000526424
  CDS Start-End: 28-282
gagctttgaagccaccccggtcaaaggatgctgagtccggagcgcctagccctaccggactacgagtatctgggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgggtctcactcttgcctaggctggagtaaagtggtgctatctcagctcactgtaacctctgcctcctgagttcatgcgattcttgtgcttcagcctcctgagtagctggga

SEQ ID NO: 118036 - DNA, 530 bp, Homo sapiens
  Payload ID: 3097
  Gene Symbol: C11orf49
  Gene Name: chromosome 11 open reading frame 49
  ENST ID: ENST00000527667
  CDS Start-End: 27-176
agctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataaacagacaagtgaactgacaagcctacgggtcaagtttctataccatttaatctgtaccagcactcttgaggctccttgccaagtgaaatatgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttg

SEQ ID NO: 118037 - DNA, 1069 bp, Homo sapiens
  Payload ID: 3097
  Gene Symbol: C11orf49
  Gene Name: chromosome 11 open reading frame 49
  ENST ID: ENST00000527784
  CDS Start-End: 27-176
agctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccgga

SEQ ID NO: 118038 - DNA, 1623 bp, Homo sapiens
  Payload ID: 3097
  Gene Symbol: C11orf49
  Gene Name: chromosome 11 open reading frame 49
  ENST ID: ENST00000528488
  CDS Start-End: 110-418
cagctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccagatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgt

SEQ ID NO: 118039 - DNA, 597 bp, Homo sapiens
  Payload ID: 3097
  Gene Symbol: C11orf49
  Gene Name: chromosome 11 open reading frame 49
  ENST ID: ENST00000532633
  CDS Start-End: 29-178
ggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataagacgggtctcattttattgctcaaactggtcttgaactcctgggctcatgttatgctcctgcctcagcctcccaaaatgctagaattacagttttaacagtgtatgccagggaacacacattctctttcgagaattcagcttcgtccaagccaccccccacaatagggtatcatttttacgggccttctggagatgcttccgaactgtgggcaaaaatggcgatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcat

SEQ ID NO: 118040 - DNA, 1141 bp, Homo sapiens
  Payload ID: 3098
  Gene Symbol: C11orf52
  Gene Name: chromosome 11 open reading frame 52
  Uniprot ID: Q96A22
  ENST ID: ENST00000278601
  CDS Start-End: 97-468
tccgggagctgccgcggaaagctcaaccaggaacccggaaatgcacaagcctcttgatgcataaaaacagctgggctcccttggagacagagcgccatgggaaaccgggtctgctgcggaggaagctggagctgcccatcaactttccagaagaaaaagaaaacaggaagccaaacaagacggacactgaagccgcagccacaacagctgcagcagaatctcccaaagggccatgaaacaacaggacatacgtatgaacgggtgttacagcagcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaacccagggatgttgtccacgttttaagcttaaagaactccaaagcccctggaattgtgggcgtcccattttctcccctggcctcttacttgccactgttaggttggagttaatagttggtttagctatgggtggatagctaaacttagctatccacatgaggttaggtggagtgtgcagggaggtaggtcttcgaccccaccattgttgctcctgctcttgcaaagtgcagaaagagcaggtaaaaagttagcccataagcacgtgggctgatcttgttggactttaattaatggtatcctttttcacacaccttaaactccaaagctgaaggggaggtgctccggaaaagcattctgagcttttacattcagacactagggctggcttgggccatttcctcagtggctgagtcaggttccagaccttaacagacaaatgggggaagggggctgaggcgtggaggaaacgctttcaggacctcaagtcagtgataaccgacagcacagtgaggcctggaaacttccctcggagggactgttggctctcgcaggtgcggggccgctaggatcaataaacggcctgagaaacat

SEQ ID NO: 118041 - DNA, 551 bp, Homo sapiens
  Payload ID: 3098
  Gene Symbol: C11orf52
  Gene Name: chromosome 11 open reading frame 52
  ENST ID: ENST00000529342
  CDS Start-End: 420-551
cagagctgagtggtgggccctgaacatccacttaaaggacaataaccaggcatccgaggaaaacactaaaaatggggtgagagaactgaacacaagaatgatgggtttcacagattctcgtagagcccatattttctactgcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgctaggttgaaatctgacactgacacagactccgggagctgccgcggaaagctcaaccaggaacccggaaatgcacaagcctcttgatgcataaaaacagctgggctcccttggagacagagcgccatgggaaaccgggtctgctgcggaggaagctggagctgcccatcaactttccagaagaaaaagaaaacaggaagccaaacaagacggacactgaagccgcagccacaacagctgcagcagaatctcccaaag

SEQ ID NO: 118042 - DNA, 1205 bp, Homo sapiens
  Payload ID: 3099
  Gene Symbol: C11orf53
  Gene Name: chromosome 11 open reading frame 53
  Uniprot ID: Q8IXP5
  ENST ID: ENST00000280325
  CDS Start-End: 148-858
gtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggttactacggtgtcagaagatctttcttatctgactcagacttccacaacagtaaacagttttcaaatgacgtctacacctccagcgtggggaagccgtttccctgtgagtcctccgcagggcagagccatgcggctctcctggagccctacttcccccaggagccctacggagactaccggcctccggcgctgacgcccaacgcgggctctctgttcagcgcctcgcccctaccgccgctcctgccaccgcccttccccggagacccagctcacttcctatttagggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagattgttttaggtgtgtcagcccattcaggactggattttcagaataagcctcaatgctgctctttgttagtggacgagggcatttatttgtaatcctctccactgtaaccccactgaaataaaacagaatgttaattaaatgtgtcagagaccgtattctagtaagataaccttacaatgtggtctttttggaactgttgtaacccattacgttctgaatcttctgttatctttgaagtatcatttttggcactgatttttcttaaattacattaaaaagtttatgcagatca

SEQ ID NO: 118043 - DNA, 2522 bp, Homo sapiens
  Payload ID: 3100
  Gene Symbol: C11orf54
  Gene Name: chromosome 11 open reading frame 54
  Uniprot ID: Q9H0W9
  ENST ID: ENST00000331239
  CDS Start-End: 180-1127
ggagctctagctcgcgtattctgaggaggcggggttggcctaggcgaagatccggactctgggtgttttgctaccgtgaccgtttagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatg

SEQ ID NO: 118044 - DNA, 1733 bp, Homo sapiens
  Payload ID: 3100
  Gene Symbol: C11orf54
  Gene Name: chromosome 11 open reading frame 54
  Uniprot ID: Q9H0W9
  ENST ID: ENST00000354421
  CDS Start-End: 158-1105
ggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaa

SEQ ID NO: 118045 - DNA, 4094 bp, Homo sapiens
  Payload ID: 3100
  Gene Symbol: C11orf54
  Gene Name: chromosome 11 open reading frame 54
  Uniprot ID: Q9H0W9
  ENST ID: ENST00000528288
  CDS Start-End: 236-1033
cgtgggggcgccatttttctcgccgcgcagggaggactgactaacgtgggcggagctctagctcgcgtattctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaagcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacctccagacaaaataatattaatagtctatcatttaacaaatatgtattgaacacctacccttctctctggagtgtacacttcatgtgggcaagggccttgttcacgactgtagcactagtgcctttaactgctagcaaagtagccactcggatgattataccaaacactttactaaagctggggatctgtctagtggggaagacaaacaataaatatataatatgtcaggtggtattaaatgctatgaaaagaaaggagtagatggactgtaaaggaggatgctatttttttgtggccatcccgcactgagacaggatgcattccacactcaaaatttggttcacatgtccagactgatagccaagttcagtggctcacgcctgtaatcctagtacttagggagaccaaggcaggaggatcacttgaggccaggagttcaaggccagcctgggcaacagagagagacccccatctctgcaaaaaaagaaaaaaaattttttaattatctgggcatggttgtgcacacctgttgtcccagctgctcaggaggctgaggcacgagaatcacttgagcccagaagttggaggctacagtgagctatgattgtttcattgcactgtagcctgggcaacacagtgagaccctgtctcaaaaagaaaaaaaaaatgactgatgaagccacacacacaccaacagagtatgaaagggttgttactcacataatgaagctttctggggaaagcagggcagctcctaagcaggatttgacaacagggaaggagactgacttggagttttttggtggttagggagtagggccagagtgatgtttcttgcatgtggtttgaatttcccactggtatcaaagaaggaaacacccaggcttgcttgctttatttttttaaagagatggtgtctcactatgttgcccaggctgggctcaagtcatcttcctgcctcggcctcccaaagtgctgggattacaggcatgggccaccatgtctggcgagcacccaggctttcttagcttgccagaggtgtagggcataaggggacgaggggtgggataaggcttaaaagccaccagcagtcaaacataaattaagtcagattcttaattacagatttcagatctgatttcagatcagagcttatttcaggtcagattccaggtgtagagatcatctgaagcagtcctgggcctcttcacactacagataccaacactgcctttactcttccattagtgtcctccaaaatggggtgcatggacagcaggtacacatgaccttccaaggggtgtgggaatattagaacatctatttatatattttatttcgtccttttaagtttctgtggttttgtgtacatttcttacgttagggatttcagttcaaaattgtattgctgatagacacaattcaaaaagcttggagaccaggtacattcacaccatctaatagagatgggggaaaagatcaaaatgcttttctttttaaattttttcttagttttctttctttatagagacagagtttcgccgtgttggccaggctgttctcgaactcctggcctcaagtgatctgcccgtctcagcctctcaaattgctgggattacaggcatgaggcactgcacctcaccca

SEQ ID NO: 118046 - DNA, 903 bp, Homo sapiens
  Payload ID: 3100
  Gene Symbol: C11orf54
  Gene Name: chromosome 11 open reading frame 54
  ENST ID: ENST00000533154
  CDS Start-End: 341-903
acaggtgtgtgccaccacgcccagctaatttttgtatttttagtagagacaggttttcaccatgttggccaggatggtcttgatctcttctcttgacctcgtgatccgccccccttggcctcccaaagtgctgggattacaggcatgagccacagcgcccggcctataaatgttttccaagttttttatgtctaaaattaaatattatgtattttatgttctcttattaggacttgaactaaaatgtcttaaaaggattaaatgttttgtaacattattcaagatattctctttgcagagatacaaagattgactaattgcctcactttcttttcagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtt

SEQ ID NO: 118047 - DNA, 552 bp, Homo sapiens
  Payload ID: 3100
  Gene Symbol: C11orf54
  Gene Name: chromosome 11 open reading frame 54
  ENST ID: ENST00000530279
  CDS Start-End: 266-552
aagatccggactctgggtgttttgctaccgtgaccgtttagaaacccttgtgtgttaaaatattggagaaggctcattctttgaccatgactcgaagtgtgtaacctttgtgctggacgccagtgttattccatagcacgcccaggtctcctccccacttttgcacctgtttcaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttgg

SEQ ID NO: 118048 - DNA, 552 bp, Homo sapiens
  Payload ID: 3100
  Gene Symbol: C11orf54
  Gene Name: chromosome 11 open reading frame 54
  ENST ID: ENST00000527003
  CDS Start-End: 323-552
aggcgaagatccggactctgggtgttttgctaccgtgaccgtttagaaacccttgtgtgttaaaatattggagaaggctcattctttgaccatgactcgaagtgtgtaacctttgtgctggacgccagtgttattccatagcacgcccaggtctcctccccacttttgcacctgtttcgtaagctcaccctttctgcctcccaggagttggctaacatgtcacaaaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagt

SEQ ID NO: 118049 - DNA, 779 bp, Homo sapiens
  Payload ID: 3100
  Gene Symbol: C11orf54
  Gene Name: chromosome 11 open reading frame 54
  ENST ID: ENST00000530620
  CDS Start-End: 62-779
gcggggttggcctaggcgaagatccggactctgggtgttttgctaccgtgaccgtttagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccag

SEQ ID NO: 118050 - DNA, 695 bp, Homo sapiens
  Payload ID: 3100
  Gene Symbol: C11orf54
  Gene Name: chromosome 11 open reading frame 54
  ENST ID: ENST00000531650
  CDS Start-End: 141-695
cgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaa

SEQ ID NO: 118051 - DNA, 1862 bp, Homo sapiens
  Payload ID: 3100
  Gene Symbol: C11orf54
  Gene Name: chromosome 11 open reading frame 54
  Uniprot ID: Q9H0W9
  ENST ID: ENST00000528099
  CDS Start-End: 300-1247
attctgaggaggcggggttggcctaggcgaagatccggactctgggtgttttgctaccgtgaccgtttagaaacccttgtgtgttaaaatattggagaaggctcattctttgaccatgactcgaagtgtgtaacctttgtgctggacgccagtgttattccatagcacgcccaggtctcctccccacttttgcacctgtttcaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaag

SEQ ID NO: 118052 - DNA, 574 bp, Homo sapiens
  Payload ID: 3100
  Gene Symbol: C11orf54
  Gene Name: chromosome 11 open reading frame 54
  ENST ID: ENST00000533585
  CDS Start-End: 274-574
gtattctgaggaggcggggttggcctaggcgaagatccggactctgggtgttttgctaccgtgaccgtttagaaacccttgtgtgttaaaatattggagaaggctcattctttgaccatgactcgaagtgtgtaacctttgtgctggacgccagtgttattccatagcacgcccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtc

SEQ ID NO: 118053 - DNA, 1356 bp, Homo sapiens
  Payload ID: 3100
  Gene Symbol: C11orf54
  Gene Name: chromosome 11 open reading frame 54
  ENST ID: ENST00000526335
  CDS Start-End: 910-1356
gatactaatctctgtgtatgtgcacttatttgttacaaagtatacttggcatatattttattttttagttgcaatgatagaaaagcatatatttaaatatcaaattataattggatagattatcagaattgaacattaaatctatttaccaagaaagtatgtttatttgtaaatgaaaataaaaatttgaatttcaaaggctaatcattccataaaagtttccatttctattcgtaatttaaattttattttgaaaaagtgatagtctaaggaactcatttaatttttggcctaaatgtgaaatatagaataaaaaacacacatatctattacagaaatacttgagatcctatatgtactatacaaatcctatatgtactgttatctacaaccatttgaacacttatccataaacccctaataagtaccttttgcttcaagacctatattccttagacccaccattagaaaattggatgttcactccagctatatgatatttaaaaaaaaaatgaatcagctgggagcagtggctcacacttgtaatcccagcattttgggaggcagaggatggcttgaggccaggaattcaagaccagcctgggcaacatagtaacaccttgtttctattaaaaaattagttttaaattttaaattacaataaaataaagtgtaagtattaaaaggccacttgtctatttctcacttggaatattaaatgctggaagctgtgtttgcctgtttatgaagatagaaacctaaatgcccttttgttctgtttatatgtttgaatgctcaatgttcatttccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgt

SEQ ID NO: 118054 - DNA, 1258 bp, Homo sapiens
  Payload ID: 3100
  Gene Symbol: C11orf54
  Gene Name: chromosome 11 open reading frame 54
  ENST ID: ENST00000527363
  CDS Start-End: 745-1258
aaaattagccgggcatgatggcacatgcctgtaatcccagctactggggaggatgagacaggagaatttcttgaacctgggaggcggaggttgcagtgagccgagatcatgccattgcactccagcctgggtgacacagcgagactccgtctcaaaaatttgggaccgttaataaacagttatatatatttgggagattagattacatgtattaaatcaagaacaataaaagctggtatttgataaagtactaaagtaaatataacatcctaaatgtttgcaatagaatgattatagaggatatgttgttggaaagtaccagaactagaaacccagtttctaagcaacctgtgaatctttggaaaattagaaaaaaaaatttggaagaatatttcaaatggctgaagatcaccgttccacttgctaaataggcatgttaagggcagaggccactcagattaatgaagtgttctattaacagttttaacgagaactcctgcagtactcttagaaacacccttaagagtcttgtctgtgttccctgttgtgattggcttggagtaggatacctgtctacctcatattacttatatttttccctgtcttcattttatctccctctggttgcatacttcatcactgaacacttaagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtgattg

SEQ ID NO: 118055 - DNA, 2442 bp, Homo sapiens
  Payload ID: 3100
  Gene Symbol: C11orf54
  Gene Name: chromosome 11 open reading frame 54
  Uniprot ID: Q9H0W9
  ENST ID: ENST00000540113
  CDS Start-End: 138-1028
gggggcgccatttttctcgccgcgcagggaggactgactaacgtgggcggagctctagctcgcgtattctgaggaggcggggttggcctaggcgaagatccggactctgggtgttttgctaccgtgaccgtttagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatctta

SEQ ID NO: 118056 - DNA, 2417 bp, Homo sapiens
  Payload ID: 3100
  Gene Symbol: C11orf54
  Gene Name: chromosome 11 open reading frame 54
  ENST ID: ENST00000617482
  CDS Start-End: 233-1003
gggggcgccatttttctcgccgcgcagggaggactgactaacgtgggcggagctctagctcgcgtattctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatctta

SEQ ID NO: 118057 - DNA, 3693 bp, Homo sapiens
  Payload ID: 3101
  Gene Symbol: C11orf57
  Gene Name: chromosome 11 open reading frame 57
  Uniprot ID: Q6ZUT1
  ENST ID: ENST00000280352
  CDS Start-End: 637-1515
aagtctcctcctttttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 118058 - DNA, 3669 bp, Homo sapiens
  Payload ID: 3101
  Gene Symbol: C11orf57
  Gene Name: chromosome 11 open reading frame 57
  Uniprot ID: Q6ZUT1
  ENST ID: ENST00000393047
  CDS Start-End: 610-1491
cttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 118059 - DNA, 2322 bp, Homo sapiens
  Payload ID: 3101
  Gene Symbol: C11orf57
  Gene Name: chromosome 11 open reading frame 57
  Uniprot ID: Q6ZUT1
  ENST ID: ENST00000420986
  CDS Start-End: 282-1160
atatctagttccggaatgtcccccttctggtgccaggcttgcttttcagttgggcctgacccacttctcttccaggaaagcgcccgccttccttctgcacccgtcaacctctggagtgtcctgaaaaccctcccttgtgggagtctctgggctgcctgttggtgggacgatttctcaggagcacgacttccggcctgaaaaggaagtctcctcctttttctcccaaaccacttcttcccccctaccccccgccacgcgaggctgcggcgcacgattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactca

SEQ ID NO: 118060 - DNA, 3739 bp, Homo sapiens
  Payload ID: 3101
  Gene Symbol: C11orf57
  Gene Name: chromosome 11 open reading frame 57
  Uniprot ID: Q6ZUT1
  ENST ID: ENST00000532163
  CDS Start-End: 767-1561
ggaagtctcctcctttttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataaggtgggaggtacaacctagttactcctcaacgcttactgaagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 118061 - DNA, 943 bp, Homo sapiens
  Payload ID: 3101
  Gene Symbol: C11orf57
  Gene Name: chromosome 11 open reading frame 57
  ENST ID: ENST00000524989
  CDS Start-End: 82-273
cttcttcccccctaccccccgccacgcgaggctgcggcgcacgcaagatgcctgatttcctcaggatcaagggattgaagaatgtcccggattccactggggaaggtcctcctgaggaatgtcatccggcacacagatgctcacaataaggtgggagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaagg

SEQ ID NO: 118062 - DNA, 517 bp, Homo sapiens
  Payload ID: 3101
  Gene Symbol: C11orf57
  Gene Name: chromosome 11 open reading frame 57
  ENST ID: ENST00000531378
  CDS Start-End: 178-517
cgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaa

SEQ ID NO: 118063 - DNA, 809 bp, Homo sapiens
  Payload ID: 3101
  Gene Symbol: C11orf57
  Gene Name: chromosome 11 open reading frame 57
  ENST ID: ENST00000525785
  CDS Start-End: 165-809
cccccgccacgcgaggctgcggcgcacgattgaagaatgtcccggattccactggggaaggtcctcctgaggaatgtcatccggcacacagatgctcacaataaggtgggaggtacaacctagttactcctcaacgcttactgaagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaa

SEQ ID NO: 118064 - DNA, 355 bp, Homo sapiens
  Payload ID: 3101
  Gene Symbol: C11orf57
  Gene Name: chromosome 11 open reading frame 57
  ENST ID: ENST00000526879
  CDS Start-End: 82-355
cttcttcccccctaccccccgccacgcgaggctgcggcgcacgcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaat

SEQ ID NO: 118065 - DNA, 2049 bp, Homo sapiens
  Payload ID: 3102
  Gene Symbol: C11orf58
  Gene Name: chromosome 11 open reading frame 58
  Uniprot ID: O00193
  ENST ID: ENST00000228136
  CDS Start-End: 379-930
acaaagctctcggccaacgctcaccgccatacacatccgcgggaacgcttcctccaccagccgaaggcggggcctctgagggcactcccgccacacagcgcgaattgagcctcggggcttcctgggaattgtagttttagtcacggacacatcttttttattcgggccagtatgcaatgaatcagaaaactacaactcccaaagtgccccggggcggcgaggggccgcaacggtgacgactgtggcagagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctgtctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctatt

SEQ ID NO: 118066 - DNA, 776 bp, Homo sapiens
  Payload ID: 3102
  Gene Symbol: C11orf58
  Gene Name: chromosome 11 open reading frame 58
  ENST ID: ENST00000528634
  CDS Start-End: 122-595
ggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgagagacggagttttgctatgttgcccaggctggtctcaaaactcctgggttcaagcgatctttccgccttccaaagtgctggaactacaggtgtgagccaccatgtccggccagggcacatttttaataggcgtgaacaacaacatgctcacaagtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaaga

SEQ ID NO: 118067 - DNA, 405 bp, Homo sapiens
  Payload ID: 3102
  Gene Symbol: C11orf58
  Gene Name: chromosome 11 open reading frame 58
  ENST ID: ENST00000524439
  CDS Start-End: 136-405
ggcagagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgataaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctgga

SEQ ID NO: 118068 - DNA, 575 bp, Homo sapiens
  Payload ID: 3102
  Gene Symbol: C11orf58
  Gene Name: chromosome 11 open reading frame 58
  ENST ID: ENST00000525684
  CDS Start-End: 122-382
ggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaaggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaa

SEQ ID NO: 118069 - DNA, 3147 bp, Homo sapiens
  Payload ID: 3103
  Gene Symbol: C11orf63
  Gene Name: chromosome 11 open reading frame 63
  Uniprot ID: Q6NUN7
  ENST ID: ENST00000227349
  CDS Start-End: 535-2871
catttagatttctcgtgtgtttgtgaaatacctttccatttacccattatttaattgggttccttttcttcttgatttgtagcagttcctcgcgtattttagtagttttatttgtggcaaagatctcctcccccgggtggcctctgccctccggcgctgggaagtccgggcggcgaggcagcctctcccggggcgttcgggctcctccggctctgccccgatgtcgttattacggccgtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagtaacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatattg

SEQ ID NO: 118070 - DNA, 1964 bp, Homo sapiens
  Payload ID: 3103
  Gene Symbol: C11orf63
  Gene Name: chromosome 11 open reading frame 63
  Uniprot ID: Q6NUN7
  ENST ID: ENST00000307257
  CDS Start-End: 380-1303
gctgggaagtccgggcggcgaggcagcctctcccggggcgttcgggctcctccggctctgccccgatgtcgttattacggccgtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacaggtcattttgagagtaaattctctcccacgtgatggattcaaaaccttttggagccagtaaacttagttccatttcacaggtgcacataaagaccttcctgcccacctcctatggacatgtccagggatacaggacaagagtggggttagaatggtagagtccaccactcttactggaaagagcttgagatttatcacctgctaatgtgaggtcattttcaaatacaaaggagaggttattatgttaaatgtggttgcccttagacctattccaaatcccaactggtatttttttttaacatattctaacctgttctaacctctaagcattttctaatggaacaaaatagatgaggtggatgaacatttgtggcttttcttcagagactcccttttttgtcttaaagaattacgtctggtggcacgttggctcatgcctgtaatcccagcactttgggaggtcgaggtgggaggatcacttgaggccacgagttcaagaccagcctggccaacatggtgaaacccatctataccaaaaatacaaaaattagccgggtgtggtgatgcacacctgtaatcccagctactcgggaggctgaggcacaagaatcgcttgaacacgggaggcagaggttgcagtgagccgagatggcgccactacactccagcctgggttatagagtgagactctgtctcaaaataaataaataaaaataaaaaaa

SEQ ID NO: 118071 - DNA, 2782 bp, Homo sapiens
  Payload ID: 3103
  Gene Symbol: C11orf63
  Gene Name: chromosome 11 open reading frame 63
  Uniprot ID: Q6NUN7
  ENST ID: ENST00000531316
  CDS Start-End: 93-2429
caggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagtaacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatattgatcttttgatttcttcatctctaccccattccttagcataatggaaaccttaaagttacccagaaataaatgtagct

SEQ ID NO: 118072 - DNA, 1033 bp, Homo sapiens
  Payload ID: 3104
  Gene Symbol: C11orf65
  Gene Name: chromosome 11 open reading frame 65
  Uniprot ID: Q8NCR3
  ENST ID: ENST00000393084
  CDS Start-End: 71-1012
acgtcatttccgcctgcgacgttacctaggagtccagcggcgcccgggccagcagcgattggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaagtactttatttctattctga

SEQ ID NO: 118073 - DNA, 2683 bp, Homo sapiens
  Payload ID: 3104
  Gene Symbol: C11orf65
  Gene Name: chromosome 11 open reading frame 65
  Uniprot ID: Q8NCR3
  ENST ID: ENST00000527531
  CDS Start-End: 104-1045
ggtctaattttaggttagggacctgcgcaattttgtggatgcaactctgtctctatgcacgttaagaaaggtttatttgaagtcatacaacagggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaaaaccaatggcaaactgtaacaaatgacaacatgtatgaacagaatttgaaatcggtaaaagaaaaaagaatgtatttttaaccttgggaatagcacagccttggatttaattttaccaacgtattattgggacctatttcagcaaactccttgtagcaaaatctgtattaccatctgcagtccaaaggagatctataaagatgcctcggttcataaaggtgcacacaggaccaccctgatggactgttactcatcttccaagggataaagccccacccttattgaccacaggcttaatggttaatgccaatgaattaagacagttctcatatcctagttgaacagtaggagagatttttaaaaatgcacatattcctgccccatctctagaaacctggtttgaatttgatcagcatcaatgttttttaaatgcagtaaaagtaatactaacatgcagccagtccaacataaatcaggttaaaggaagaaaagctgagtagtggaaaagtggcaagcccatactgcactctacctgccatgcttccctggggaggccacactcctgatttcttgtctcacatacccttaccagattggtgaatgactggcataggtactaacagcacagacactgaaatttgtttgacttccttttttctgccctggatcaagacaaggcagtgatcctgattacatgtgtttgctctgcaggcccaaaccctattcaggtgagctgtcccaaagttaagacagcagagaggtactgaggtagcaccagcagtaaactagtctggccctcattcctaagccatgttcctctagtaatgatgctgacaatttgatctccatttgtctgactaattagttctgaacctgagcagggaaaaaggagatataaatttctgatttttcttaaaccctaatggaaaccattctgaaaataataataccatatggaatatctaaatgtcaaagaattgatttatgaattgaaaactagagactacttacaatgctctaacattccaagaaactcaagggggctgaaggcatttctaaaccagtatttttggatgtgtgaaaaggctaagtgcacaatctcctcctttctgctgcccagccacatccccctatgttaaaatgaagcagtgctcttcacatcagtgacttcctgatgagatacacagtctacctgagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaacaaggtatttcaaatattctcacatctaagcaagtaagttattttaagacagtgctcctctattagcacaagtggttaacaaaacttcactaactatattgttttccttcatttcttttcttatctgaaggtctttctaatgggtactctagattaatgcattggtaaatcaaaatatttggtcctaaattaaactggattcagaactagaa

SEQ ID NO: 118074 - DNA, 456 bp, Homo sapiens
  Payload ID: 3104
  Gene Symbol: C11orf65
  Gene Name: chromosome 11 open reading frame 65
  ENST ID: ENST00000524755
  CDS Start-End: 1-317
ggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgaagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaa

SEQ ID NO: 118075 - DNA, 1263 bp, Homo sapiens
  Payload ID: 3104
  Gene Symbol: C11orf65
  Gene Name: chromosome 11 open reading frame 65
  Uniprot ID: Q8NCR3
  ENST ID: ENST00000525729
  CDS Start-End: 71-811
acgtcatttccgcctgcgacgttacctaggagtccagcggcgcccgggccagcagcgattggaatttcaaatgccttggaaagaggaatcagaatttacaaagcaggataaggctgccagagtcattcagcaggcctggaaaagtttccttgttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggaatattcttcaggatcttattcagcattaaaatggaatatgaagaatttttatcttctccaactcctgctaatgtcaacaccattctaccccaatggtaagtctgaaatgaatgactcaaaggtaaaactgcctcccaacaccaagaaaacaaatgctctccactacattaaagcttctgataggcctcctcagaagataatctggtataaaactctaaggtaaaataaccagaagcaaagacactgaaaagcataaaacttctttttctactagagaagaagaatggtttaagactacataggaattaattttttaagatattaatgcatttaggcttaaaaacatttcatttttcactcacctctccctctcattctttaccaaccacccctaccaccaccatacacacttatgagacatcgattcctacctattcaaattataggcctactacactatttcttcagagttctggtcaactctcaagcagtactcatcagtcagaccatccattctagcaatttctgtatgcactgttaaaaatctcatg

SEQ ID NO: 118076 - DNA, 582 bp, Homo sapiens
  Payload ID: 3104
  Gene Symbol: C11orf65
  Gene Name: chromosome 11 open reading frame 65
  ENST ID: ENST00000533583
  CDS Start-End: 11-582
ggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgc

SEQ ID NO: 118077 - DNA, 973 bp, Homo sapiens
  Payload ID: 3104
  Gene Symbol: C11orf65
  Gene Name: chromosome 11 open reading frame 65
  Uniprot ID: Q8NCR3
  ENST ID: ENST00000529391
  CDS Start-End: 11-952
ggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaagtactttatttctattctga

SEQ ID NO: 118078 - DNA, 2711 bp, Homo sapiens
  Payload ID: 3104
  Gene Symbol: C11orf65
  Gene Name: chromosome 11 open reading frame 65
  Uniprot ID: Q8NCR3
  ENST ID: ENST00000615746
  CDS Start-End: 134-1075
agtccagcggcgcccgggccagcagcgattggtctaattttaggttagggacctgcgcaattttgtggatgcaactctgtctctatgcacgttaagaaaggtttatttgaagtcatacaacagggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaaaaccaatggcaaactgtaacaaatgacaacatgtatgaacagaatttgaaatcggtaaaagaaaaaagaatgtatttttaaccttgggaatagcacagccttggatttaattttaccaacgtattattgggacctatttcagcaaactccttgtagcaaaatctgtattaccatctgcagtccaaaggagatctataaagatgcctcggttcataaaggtgcacacaggaccaccctgatggactgttactcatcttccaagggataaagccccacccttattgaccacaggcttaatggttaatgccaatgaattaagacagttctcatatcctagttgaacagtaggagagatttttaaaaatgcacatattcctgccccatctctagaaacctggtttgaatttgatcagcatcaatgttttttaaatgcagtaaaagtaatactaacatgcagccagtccaacataaatcaggttaaaggaagaaaagctgagtagtggaaaagtggcaagcccatactgcactctacctgccatgcttccctggggaggccacactcctgatttcttgtctcacatacccttaccagattggtgaatgactggcataggtactaacagcacagacactgaaatttgtttgacttccttttttctgccctggatcaagacaaggcagtgatcctgattacatgtgtttgctctgcaggcccaaaccctattcaggtgagctgtcccaaagttaagacagcagagaggtactgaggtagcaccagcagtaaactagtctggccctcattcctaagccatgttcctctagtaatgatgctgacaatttgatctccatttgtctgactaattagttctgaacctgagcagggaaaaaggagatataaatttctgatttttcttaaaccctaatggaaaccattctgaaaataataataccatatggaatatctaaatgtcaaagaattgatttatgaattgaaaactagagactacttacaatgctctaacattccaagaaactcaagggggctgaaggcatttctaaaccagtatttttggatgtgtgaaaaggctaagtgcacaatctcctcctttctgctgcccagccacatccccctatgttaaaatgaagcagtgctcttcacatcagtgacttcctgatgagatacacagtctacctgagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaacaaggtatttcaaatattctcacatctaagcaagtaagttattttaagacagtgctcctctattagcacaagtggttaacaaaacttcactaactatattgttttccttcatttcttttcttatctgaaggtctttctaatgggtactctagattaatgcattggtaaatcaaaatatttggtcctaaattaaactggattcagaactag

SEQ ID NO: 118079 - DNA, 1619 bp, Homo sapiens
  Payload ID: 3105
  Gene Symbol: C11orf68
  Gene Name: chromosome 11 open reading frame 68
  Uniprot ID: Q9H3H3
  ENST ID: ENST00000438576
  CDS Start-End: 87-968
cggccgctgcggccgctgaggcccgcggctccgccctgtggctgcgcctgtctataaagttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctaggggggccaaattggggagactgcccactcccccctccatgctggggttggatcctcctgtcttcctccttgtcctatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaata

SEQ ID NO: 118080 - DNA, 1559 bp, Homo sapiens
  Payload ID: 3105
  Gene Symbol: C11orf68
  Gene Name: chromosome 11 open reading frame 68
  Uniprot ID: Q9H3H3
  ENST ID: ENST00000449692
  CDS Start-End: 32-910
aaagttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctaggggggccaaattggggagactgcccactcccccctccatgctggggttggatcctcctgtcttcctccttgtcctatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaa

SEQ ID NO: 118081 - DNA, 1528 bp, Homo sapiens
  Payload ID: 3105
  Gene Symbol: C11orf68
  Gene Name: chromosome 11 open reading frame 68
  Uniprot ID: Q9H3H3
  ENST ID: ENST00000530188
  CDS Start-End: 147-902
caggaacagttgttatcccattgtaaagatgaggcaactgaggcgcatcgacagtaactcttactcaaggccacagtttaatccagtgcctggcatctgtagttattgtctcagaccctgccctgactcggttccctcacagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctaggggggccaaattggggagactgcccactcccccctccatgctggggttggatcctcctgtcttcctccttgtcctatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtc

SEQ ID NO: 118082 - DNA, 2193 bp, Homo sapiens
  Payload ID: 3106
  Gene Symbol: C11orf70
  Gene Name: chromosome 11 open reading frame 70
  Uniprot ID: Q9BRQ4
  ENST ID: ENST00000434758
  CDS Start-End: 29-832
cccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctataccaaaaaagttgtggaatttttacagaaagttacaaggaattagaaatctagttcatatttgttgcattgtgattcaagtgaatcctcaattttccatgtattttaatttataagctaattaattatggattgaaaatgtagcagaaaactaaacatgtctaccactgatcattaatatgaattgttagtttatttaacttgtttcatttaattacatttcttcattgcacaagcgtttacatctgtaaagctaggcaaagcataacaattcttttgcttcatttgttccacttataagcctcagtaaagaagtaacgttctggggcctggcacggtggctcacgcctgtaatctcagcactttgggaggccaaggcgggcggatcacgaggtcaagagatcgagaccatcctggccaacatggtgaaaccccgtctctaccaaaagtacaaaaattagctggctgtggtggtgtgtgcctgtagtcccagctactcaggaggctgaggcaagagaatcacttgaacccgggaagtgaggttgcagtgagccgaggctgtgccactgtactctagctctggcaacagagcaagactccgtctcagaaaaaaaaaaggttctgaaagtggttgtaaactcttgtatcacataataaattaaaactgcagctgtcccacggctaatacaagagctacatgtaaacagagaaagttgcctgatggcattagtaagtcgttcaaagagtgagaagcaggttatcttagtactgttccttatttcattcatagaatgaatgtataacctagattgtttttggtttattttgatggcaaaaatcattgacatatatcccatgggtcatgggaagcctgtaagaaatgttgaggtttgaggaggagcaagtttgaaagatgtgtttctgtgttgtgggataaagacgataatcttggacttgaacctggatttgaatctggaatgcagctggcaatttgggtatagagctcaggagaaagagtatgttttacttctaatacctaacacaatgacttggcatattaaatgtttattgaatgaataactactttctagatatcctcataatacccatagatttttttaaattacataaaaacataaaatcaagaactg

SEQ ID NO: 118083 - DNA, 349 bp, Homo sapiens
  Payload ID: 3106
  Gene Symbol: C11orf70
  Gene Name: chromosome 11 open reading frame 70
  ENST ID: ENST00000529204
  CDS Start-End: 1-287
cattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttga

SEQ ID NO: 118084 - DNA, 845 bp, Homo sapiens
  Payload ID: 3106
  Gene Symbol: C11orf70
  Gene Name: chromosome 11 open reading frame 70
  ENST ID: ENST00000526781
  CDS Start-End: 17-742
cccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgtaagtgtgagagaacttttgcaaccaaagaatttaattactttttattaatagagttgttacaactggagttaacaatcaggacaatgttatgcctaggagaaaagacaatgttatttagagttttgttaaaattaaaagttgatagagtatg

SEQ ID NO: 118085 - DNA, 520 bp, Homo sapiens
  Payload ID: 3106
  Gene Symbol: C11orf70
  Gene Name: chromosome 11 open reading frame 70
  Uniprot ID: Q9BRQ4
  ENST ID: ENST00000534360
  CDS Start-End: 14-313
agccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttga

SEQ ID NO: 118086 - DNA, 780 bp, Homo sapiens
  Payload ID: 3107
  Gene Symbol: C11orf71
  Gene Name: chromosome 11 open reading frame 71
  Uniprot ID: Q6IPW1
  ENST ID: ENST00000325636
  CDS Start-End: 220-663
tgctctcagcgggcgacgacgtgcgcggacggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggagttactacctggaccctgaagctatctgagtctgcaacccctgatttaagatggtgttcaacatgcagccattcaaatatttttgaaattttagtaatatgaactgatttgtgatataattacatttatattatttaagataaaaattggatatgaaattgtatgtattatatgatcttacctatatgaatgaaatatgcattaaaaaactagaattgc

SEQ ID NO: 118087 - DNA, 372 bp, Homo sapiens
  Payload ID: 3107
  Gene Symbol: C11orf71
  Gene Name: chromosome 11 open reading frame 71
  Uniprot ID: Q6IPW1
  ENST ID: ENST00000634180
  CDS Start-End: 1-372
atggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaa

SEQ ID NO: 118088 - DNA, 1113 bp, Homo sapiens
  Payload ID: 3108
  Gene Symbol: C11orf73
  Gene Name: chromosome 11 open reading frame 73
  Uniprot ID: Q53FT3
  ENST ID: ENST00000278483
  CDS Start-End: 227-820
aagccccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagta

SEQ ID NO: 118089 - DNA, 1694 bp, Homo sapiens
  Payload ID: 3108
  Gene Symbol: C11orf73
  Gene Name: chromosome 11 open reading frame 73
  ENST ID: ENST00000533986
  CDS Start-End: 239-823
aaaaccgggtgtaagccccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtcgccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataa

SEQ ID NO: 118090 - DNA, 1409 bp, Homo sapiens
  Payload ID: 3108
  Gene Symbol: C11orf73
  Gene Name: chromosome 11 open reading frame 73
  ENST ID: ENST00000528004
  CDS Start-End: 199-477
agtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggtaattattgaacatctacttgctgcctactttcaacatctgcatgtgtgtgtgaatattaaatatcacaccaagacattgttcagaggagacagaatagtgagctgagataaatgagaatctctctatggaagattagactggagcatgaacttgaaatatgagagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtcgccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtga

SEQ ID NO: 118091 - DNA, 499 bp, Homo sapiens
  Payload ID: 3108
  Gene Symbol: C11orf73
  Gene Name: chromosome 11 open reading frame 73
  ENST ID: ENST00000618164
  CDS Start-End: 80-475
tgctgggaacaatcccatttcctgagggaatgggaggatctgtctacttttcttatcctgattcaaatggaatgccagtatgcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgg

SEQ ID NO: 118092 - DNA, 633 bp, Homo sapiens
  Payload ID: 3109
  Gene Symbol: C11orf74
  Gene Name: chromosome 11 open reading frame 74
  Uniprot ID: Q86VG3
  ENST ID: ENST00000347206
  CDS Start-End: 104-547
gtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataa

SEQ ID NO: 118093 - DNA, 863 bp, Homo sapiens
  Payload ID: 3109
  Gene Symbol: C11orf74
  Gene Name: chromosome 11 open reading frame 74
  Uniprot ID: Q86VG3
  ENST ID: ENST00000334307
  CDS Start-End: 116-781
tctctctgggatgtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctact

SEQ ID NO: 118094 - DNA, 1062 bp, Homo sapiens
  Payload ID: 3109
  Gene Symbol: C11orf74
  Gene Name: chromosome 11 open reading frame 74
  Uniprot ID: Q86VG3
  ENST ID: ENST00000446510
  CDS Start-End: 293-958
gaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaattt

SEQ ID NO: 118095 - DNA, 930 bp, Homo sapiens
  Payload ID: 3109
  Gene Symbol: C11orf74
  Gene Name: chromosome 11 open reading frame 74
  Uniprot ID: Q86VG3
  ENST ID: ENST00000532470
  CDS Start-End: 177-842
acggtgtcctgcctgtctggatgcttaggagcgcgactcaaaactacacccctgacgaccctggagaaagatactgtactgtgaaacattaaatcttgctgatccgtgctggccatgttttcttgattgctccagagtagcaagtaacctcatatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataatt

SEQ ID NO: 118096 - DNA, 631 bp, Homo sapiens
  Payload ID: 3109
  Gene Symbol: C11orf74
  Gene Name: chromosome 11 open reading frame 74
  ENST ID: ENST00000530697
  CDS Start-End: 383-631
tcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacaggtgacccgataggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaa

SEQ ID NO: 118097 - DNA, 801 bp, Homo sapiens
  Payload ID: 3109
  Gene Symbol: C11orf74
  Gene Name: chromosome 11 open reading frame 74
  Uniprot ID: Q86VG3
  ENST ID: ENST00000534635
  CDS Start-End: 270-713
tagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataatt

SEQ ID NO: 118098 - DNA, 694 bp, Homo sapiens
  Payload ID: 3109
  Gene Symbol: C11orf74
  Gene Name: chromosome 11 open reading frame 74
  ENST ID: ENST00000531554
  CDS Start-End: 153-694
gtgtagctttggaaatctgtctttgttgctctgggagaggggactcctggaatgtgtctgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatt

SEQ ID NO: 118099 - DNA, 861 bp, Homo sapiens
  Payload ID: 3109
  Gene Symbol: C11orf74
  Gene Name: chromosome 11 open reading frame 74
  ENST ID: ENST00000528092
  CDS Start-End: 165-494
aggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtgg

SEQ ID NO: 118100 - DNA, 366 bp, Homo sapiens
  Payload ID: 3109
  Gene Symbol: C11orf74
  Gene Name: chromosome 11 open reading frame 74
  ENST ID: ENST00000527108
  CDS Start-End: 95-366
tgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacgga

SEQ ID NO: 118101 - DNA, 937 bp, Homo sapiens
  Payload ID: 3109
  Gene Symbol: C11orf74
  Gene Name: chromosome 11 open reading frame 74
  Uniprot ID: Q86VG3
  ENST ID: ENST00000617650
  CDS Start-End: 168-833
aggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaattt

SEQ ID NO: 118102 - DNA, 1807 bp, Homo sapiens
  Payload ID: 3110
  Gene Symbol: C11orf80
  Gene Name: chromosome 11 open reading frame 80
  ENST ID: ENST00000360962
  CDS Start-End: 1-1719
tggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcacc

SEQ ID NO: 118103 - DNA, 1666 bp, Homo sapiens
  Payload ID: 3110
  Gene Symbol: C11orf80
  Gene Name: chromosome 11 open reading frame 80
  ENST ID: ENST00000527634
  CDS Start-End: 228-1610
ggactcgggcgtgggcactggcggagttccaagcccgggctgaggagggggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcacaactacacatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatc

SEQ ID NO: 118104 - DNA, 2135 bp, Homo sapiens
  Payload ID: 3110
  Gene Symbol: C11orf80
  Gene Name: chromosome 11 open reading frame 80
  Uniprot ID: Q8N6T0
  ENST ID: ENST00000525908
  CDS Start-End: 8-2041
ggaagggatgggctcgcgctgccgggcgtgggcgtggactcgggcgtgggcactggcggagttccaagcccgggctgaggagggggcggcggcggcggcggcggcggcgggcgggtacccttcgactgggcgttgccgctgttccctgcgcggcatggaggggacggccgtggccgtgttcgagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtcc

SEQ ID NO: 118105 - DNA, 581 bp, Homo sapiens
  Payload ID: 3110
  Gene Symbol: C11orf80
  Gene Name: chromosome 11 open reading frame 80
  ENST ID: ENST00000526260
  CDS Start-End: 1-326
aaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgaggtgaaggcgtaaagccttgttgtccctctgcatgttttactctcctctcgagtacgaattagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatat

SEQ ID NO: 118106 - DNA, 810 bp, Homo sapiens
  Payload ID: 3110
  Gene Symbol: C11orf80
  Gene Name: chromosome 11 open reading frame 80
  ENST ID: ENST00000531415
  CDS Start-End: 1-632
gagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagctaaccctagaaaaaaaggactcagcccagggcactgaggacgcacctgataacagcagcctggagctcctagcagtgcttaaacagccttcccagcccacagcagcaggggtacagcagctctcacattcagtcactagcagagatgccagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggc

SEQ ID NO: 118107 - DNA, 450 bp, Homo sapiens
  Payload ID: 3110
  Gene Symbol: C11orf80
  Gene Name: chromosome 11 open reading frame 80
  ENST ID: ENST00000532089
  CDS Start-End: 1-450
aaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatat

SEQ ID NO: 118108 - DNA, 1821 bp, Homo sapiens
  Payload ID: 3110
  Gene Symbol: C11orf80
  Gene Name: chromosome 11 open reading frame 80
  ENST ID: ENST00000525449
  CDS Start-End: 274-1731
ataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaa

SEQ ID NO: 118109 - DNA, 1948 bp, Homo sapiens
  Payload ID: 3110
  Gene Symbol: C11orf80
  Gene Name: chromosome 11 open reading frame 80
  ENST ID: ENST00000532565
  CDS Start-End: 513-1892
ggaggggacggccgtggccgtgttcgagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggcaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcacaactacacatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatc

SEQ ID NO: 118110 - DNA, 548 bp, Homo sapiens
  Payload ID: 3110
  Gene Symbol: C11orf80
  Gene Name: chromosome 11 open reading frame 80
  ENST ID: ENST00000524551
  CDS Start-End: 161-548
gctcagaggctctaggtggctcccggcggcggttcgcggtctcggggccctgcagcgtcgagtgcgcaggcgcggcgggcagttgcttctgcaggaagcctttttggtggcatggtcctcaagaagttcctaaaaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatat

SEQ ID NO: 118111 - DNA, 1616 bp, Homo sapiens
  Payload ID: 3110
  Gene Symbol: C11orf80
  Gene Name: chromosome 11 open reading frame 80
  ENST ID: ENST00000532727
  CDS Start-End: 13-156
ctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggcaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcacaactacacatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatccc

SEQ ID NO: 118112 - DNA, 367 bp, Homo sapiens
  Payload ID: 3110
  Gene Symbol: C11orf80
  Gene Name: chromosome 11 open reading frame 80
  ENST ID: ENST00000531400
  CDS Start-End: 130-332
ggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggtcagatttcatttcagtgtaaaggtaaatggaatcctctccacagagatctttggggtggagaatgaacccactttgaaccttgggaatggaattgctcttt

SEQ ID NO: 118113 - DNA, 583 bp, Homo sapiens
  Payload ID: 3110
  Gene Symbol: C11orf80
  Gene Name: chromosome 11 open reading frame 80
  ENST ID: ENST00000534325
  CDS Start-End: 538-583
gattagggccaagggccgcatctcgccgccaccgtgggaaactatctttgagaggagggaggagtcgtggcctggcctcattcccgctcacctccagccttggccgcctctcgcgggctcttccccgccccgaacctcccacctgcgggcccactggcacccgcggcgctcagaggctctaggtggctcccggcggcggttcgcggtctcggggccctgcagcgtcgagtgcgcaggcgcggcgggcagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaaga

SEQ ID NO: 118114 - DNA, 1786 bp, Homo sapiens
  Payload ID: 3110
  Gene Symbol: C11orf80
  Gene Name: chromosome 11 open reading frame 80
  ENST ID: ENST00000540737
  CDS Start-End: 163-1698
actggcggagttccaagcccgggctgaggagggggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcacc

SEQ ID NO: 118115 - DNA, 2024 bp, Homo sapiens
  Payload ID: 3111
  Gene Symbol: C11orf84
  Gene Name: chromosome 11 open reading frame 84
  Uniprot ID: Q9BUA3
  ENST ID: ENST00000294244
  CDS Start-End: 300-1445
ggctggccggccgggcgggcgccgacaatgagcctccataaaagggagcggcggggggcaggggccccggattgagccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaaga

SEQ ID NO: 118116 - DNA, 729 bp, Homo sapiens
  Payload ID: 3111
  Gene Symbol: C11orf84
  Gene Name: chromosome 11 open reading frame 84
  ENST ID: ENST00000535820
  CDS Start-End: 1-88
caaagacagggaagtggcagaaggaggccttccccgggcggagagcccctctccaggcctcaccccttcacgtagatcacagttttaactgtctcaagtttcagcttgagtcacattccagtcctggctccctgagaccgagtgtgctgcttggacttgagcgtgtcccgagtctcctggtcctctccggtggatccctgctctaaatggctgacctcttccactgtctaatgggtcttctgatttcattctcgaaagggagccctcatttcaagtcctggggtaccctgtgcgcaaactccatctatctggagtggtgagtagatgagaagagaatccctgagattctaggtttctttggggtgagtgggcaaagtctgagaggaaggggcttcagcaggctgcttgagtgatctgagggggcggaggcaattgtagggtgttgtcagcagtggcagccttcgtggaggttggagatgcctgggaaaccatagaggatacctcactggtacacaagtgttcctggagcctgtgcccgagggaggcaccctgggagatggcatgagtgagacagcctttgtcccccaaaattctgtgtccaggtatataggctggaggcagtaaatctttaaaaaccaggggcccccgtggcggttctttgcggagcagaggctctggacctgtggtttcagacgatctcacgaacccaaagcttggacagatttctca

SEQ ID NO: 118117 - DNA, 554 bp, Homo sapiens
  Payload ID: 3111
  Gene Symbol: C11orf84
  Gene Name: chromosome 11 open reading frame 84
  ENST ID: ENST00000540893
  CDS Start-End: 1-339
gagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagggagccctcatttcaagtcctggggtaccctgtgcgcaaactccatctatctggagtggtatataggctggaggcagtaaatctttaaaaaccaggggcccccgtggcggttctttgcggagcagaggctctggacctgtggtttcagacgatctcacgaacccaaagcttggacagatttctcagaaacctgtgaggcttcgaccaaaatgtctctactttctgtgttgttatgtacgtattgaagttctctgaagactttatttaaataaagatcctgccactttaaaaaaaa

SEQ ID NO: 118118 - DNA, 843 bp, Homo sapiens
  Payload ID: 3112
  Gene Symbol: C11orf85
  Gene Name: chromosome 11 open reading frame 85
  Uniprot ID: Q3KP22
  ENST ID: ENST00000301896
  CDS Start-End: 75-725
tggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctc

SEQ ID NO: 118119 - DNA, 838 bp, Homo sapiens
  Payload ID: 3112
  Gene Symbol: C11orf85
  Gene Name: chromosome 11 open reading frame 85
  Uniprot ID: Q3KP22
  ENST ID: ENST00000432175
  CDS Start-End: 67-717
agagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaa

SEQ ID NO: 118120 - DNA, 2046 bp, Homo sapiens
  Payload ID: 3112
  Gene Symbol: C11orf85
  Gene Name: chromosome 11 open reading frame 85
  ENST ID: ENST00000530735
  CDS Start-End: 274-618
ctggtgggtgcgcggcacgagccccgaagttgcttaggagctggcgagccagtccctcaaaacgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtagggaaagaagcatacgacttctggaaaagttactctttaaggatgcatccacattcaggttttaattatttcctacaaactgagtcacaacctccacttgataacttggcttcctcctgctacatctcctttgcaaaggaactttatgtttttccatgggaatttaaagcctgtattctttctcagttttcctagttgaaatgtcagcacctttgaggctgagagctttttgttttcaccagtttccagccttgggcagctctcttttgttgcagctggcatagagaaagattccggaggactgcctccttccagggctctgggaaacctcaccatcccaaccactgcctggtacttgacgttcaggaaactcgactgtaaatacacagacaaggctgctgtgtcttcatttaaattggcaacatttgcaattgccttattccgacttcattttcattcctttctacccggttcctctagctttaggttttcctacagaagaagactgagcaggtgatcaactttacaaattggtggaagcaatggacaaggagttagagttctgggggttggccctggattccagtcctggcatagccaccacttagctgtgtgaccgttggcaaatcatatatcaacttggatcttaattgcctcatttggaaaatgagaggtctaaactagcttttcctcttctgacttcacaattcggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagtt

SEQ ID NO: 118121 - DNA, 1037 bp, Homo sapiens
  Payload ID: 3112
  Gene Symbol: C11orf85
  Gene Name: chromosome 11 open reading frame 85
  ENST ID: ENST00000530444
  CDS Start-End: 212-742
cgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagtta

SEQ ID NO: 118122 - DNA, 333 bp, Homo sapiens
  Payload ID: 3112
  Gene Symbol: C11orf85
  Gene Name: chromosome 11 open reading frame 85
  ENST ID: ENST00000532617
  CDS Start-End: 1-178
aatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagaagccatcatctgtcacatgccagagggtgcccctcaagagtgggagagcaggggctgaactgctgagttcccgctgcgtcctgttgctatgctgcctgcacccttggtggggagaagagaagaggtggactgctgcggaggacctggcaaaca

SEQ ID NO: 118123 - DNA, 1187 bp, Homo sapiens
  Payload ID: 3113
  Gene Symbol: C11orf86
  Gene Name: chromosome 11 open reading frame 86
  Uniprot ID: A6NJI1
  ENST ID: ENST00000308963
  CDS Start-End: 87-434
agatgggtggaggcactgggccacctcagagggccagtgtcttgctgaggggccggagcagtcctgtgcctgcagcctccggagccatgggaacagggctgcgaagtcagtccttgcgagagccccgaccctcctatggaaagctgcaggagccctgggggaggccccaggagggccaactccgcagggcgctaagcctcagacaggggcaagagaagtccaggtcccagggcctcgagagaggcacagaagggccagatgccactgcccaggagcgggtgccggggagcctgggggacacagagcagctgatccaagcccagcgaagaggcagccggtggtggctgaggcggtaccaacaggtaagaagaaggtgggagagctttgtcgccatcttccccagcgtgactctgagtcagccggcctccccgtagcccacactgggcaccatcagctaaagatgctggaagccatcgtggcccccttgctgtgcctggaccagcccaccgtgtctgctgacctacctcttcacagctctctggactttggctgggtggccctaggaggcttctgccaccagctcactggagtcgccacgtggctgccactcttagctctggcccttccactccagcactagctctctttgaagatcccagcagggtcaaaaagaagggggctcagctgtctgccctctgggcttgggtaggggccttggactatgattctatgaaggtttagaagaagcctgcccggaatgggggctgtggacgctcctgccccacacgaccagctgtcaacttccaggacggagcttgatgaagccagacccatggccgagaggctcacggacgttgcctggtcactgggccatgacccaactgcccttcttgtcagttgctgatggtgggccagggcgcaggtctccctcccagatggtgagccctctggggcaaggaccacagctgggtggccctcctggctgagcactctgtgctgaaaacctttgaacctcacggtgtcctgatgaaggaagcagaggaagtcttcctccctgtgtgacagagggggaaactgaggcccagagtggggaagggatttcttggttttgacatctccgaccccaccccaccccatccagtgtccagcactggagtcgaacacagtaataaagatgctgagaaaaa

SEQ ID NO: 118124 - DNA, 5884 bp, Homo sapiens
  Payload ID: 3114
  Gene Symbol: C11orf87
  Gene Name: chromosome 11 open reading frame 87
  Uniprot ID: Q6NUJ2
  ENST ID: ENST00000327419
  CDS Start-End: 404-997
gaagcggcggcgaaggcggcggcggcggcggcggcggcggcagcagcgcggctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccttggtcgccttgcttgccagcagttgctcccttagtccttggctcgctcgcacaccccctcccgctacagggagcagttttgggtggcgtgggctccgtcctcttcttggctggtaggaacggtgtgcccaagaggggaagcctagtgggcctggcccctcccagccccgcgccaatgagtgccagggcgccgaaggagctgaggctggcgttgccgccgtgtctcctcaaccggacctttgcttcccccaacgccagcggcagcggcaacacgggtgcccgcggcccaggcgcagtaggcagcggcacctgcatcacgcaggtgggacagcagctcttccagtccttctcctccacgctggtgctgattgtcctggttaccctcatcttctgcctcatcgtgctgtccctctccactttccacatccacaagcgtaggatgaagaagcggaagatgcagagggctcaggaggaatatgagcgggatcactgcagcggcagccgcggtggcggggggctgccccgacctggcaggcaggccccaacccacgcaaaggaaacccggctggagaggcagccccgggactctcccttctgcgccccttccaacgcctcgtcgttgtcctcttcgtcccctggcctcccgtgccagggtccctgtgctcctccgcctccaccgccagcctccagtccccaaggagcacacgcagcttcctcctgtttggacacagctggcgagggccttttgcaaacggtggtactgtcctgatcgtctagcccctctcgttccccgtcctcgtttccagcatctttgccacccttgcttttttccttcttccttccttttccattttcctctggcccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttcccattccaccccgcgctcccctcaattaggaggagaaaccgcacaagctaccaaatatataaaaggcattgattcccggagcaaagggaggggagggggcccggtaatgtacatagctgtcaagttaagatttagtttccttccttcccctctgacccctaagctttcacttttcctttagcttccctttcctccccattcccaccctcagccgggctcaggcaatagtatattataaagaaaatgtctacattaagcaccaggactgcaagaggccatagagaatagtccccggaaagtgtttatgacaggtacccctcgccagtccgcccatttctcaccctttggttaaccattacattttccaggacagagcatttaatttactttttaaaatgaccctcgctggccgagcataagtacgttaaaatctttaaatgagttttttttaaaaagctaacgctttcattccctgccccgcccccacccgtacacctttgacttgtgacattttcaggatttacaaaggatctgggagctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaagtattaggtgatgtgcagtactgaaagtgcagtatctaaccaactagaacgtttgttttatttttagaacaagtgcacctttgttatatatttagtatattggtaccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacacgctttattttttcttttgcaaataatagaaaaaacacaaccacagaaacaaacaaataatggatgtgcaagaatgccatctattaaaaacatggttaatatttaaacagtgcctgtagttctccctgcatgcagttaccacctggaggcagtggtgtgtgtgcttgcttgtactgtatgtggttggggatgagactggtggggatgttgggcaatttggatgataagacatgcgaatttcaagaaaagctagatccagtaattacttataggatacaaatgtttgcagcttgtttgtttagttacaaatctgtgcctgcagcaaaagaaaggctctctttctcagtctgtcctaacttcactgaacatacaaaaatactgagaaaaaaagaaagtgagaaaataagataaatattttattattttctaatgccagacaaggccatctatgttagaaatggaagtagtctatagttatttaccaccttgtttcctttggttgaatgacagaagaagccagaagcatattacaatattaattatatgcagtgacatctcttcttggaaatcaagcctttgacagctattcaaatttttggaaaatgtatgaatgaaagtgatctgcaaaaagctctaccaagagagtccttactatcctgcagggtgtaaggcaacagtgcccctatgagcatccctctcccaagcaactcattgttctaaattgtctacttggtccagacatatgtgctcttatccagaggaaacattacctctaatatttttggtcatctattaaattgcccaagctcagtttgcatcttttataaaaataatttaataaacttaattttaatcacccataagataatcacctttcctgaagcacagaagatcatcattgaagcatgccatcttgtaatattaggaagaccaggtataatctttgggtacaatatattaaacaatgaaccagtttttctccagtgccttagtcacttcctagtaataggtaaaagagtgcattaactccctcaggccactagggaatcctgtagtgcatcagagttctacactgtacatcagaatgactaaggcactgtgaagaagaaagtccattgatttttgtagcttaccctcatccagtggtagctctttaataccttattacagaatgacttttggacttgaaatttgaatagaatcagggtcccagaagggagcttcatcatttccaatgagctccaataagtgcatggatattactttctttcccttatttggtgcactttctacagcgaataatttcccattttattaaagcaataagatgttctgttgtgagcagtgctggataacgattccattttcttggtgctgaagctacgcatatgttcttgccttatgaatcatagtatattcaaggcatgcaataataatccccttccaaggagcagcctgtacactctgtgggggtaattatgaaattgtcctacatcatttctccccaaaggaatgcaaggagcaagagaaataaaagcattatgtatattgtaaaacaaatgatctcaatacctctcaacgtgggcacacatctgtaatacacttttattgtgcaactttaaatgtgtgtgcctttctccattaattgactgtagtttaatatttttaatagtgctctgtgtaaagatgatgcagtttgtgagtcagatttcatactgagcttaatatactcaaaacctaagcttccagtggtattacttgtgatttttttatgagatagagaattacatgaaattctagtaatccagtttccacacaaaattatttcaataagcacatatccaagcaatttgtacagaccttgtttaaagcactgcttcttatagggctcaattggcagtctcaggagcttgggatgctaccaacagggcatttaggttttcatttttatgaaacaaaaggcaatctggaaatagctaaatttattttaaggattttattcactgatgtcccgtcaaactaaatgcttcaaacccctatagctacagcttaacttctgcacttgctattcagtattaataaggtggcatgcttgattcttattgtttttaaaaatgagaaaatttggagagagaatactattatgtcaacggtacaagactctgaatcttgaagatgtagatggatataatatttagactttatatacacccatagatatgtatttatatatgcatacgttttgtataaatttacaattgactttttgtattctcttttctgtcattacaagaatgagatggaaaccaaaatagttgttccatcctcttacccaaagaggatactgaaaagtccggtatgtgcatgcacttgtttctctggggtcaaatctgaatgactttctctttaataatgaaaggggagagtcctggttagcttggaaaattggtaattagataagcttcctttcctaggttagtgactcaaatgtagcaatgataataaagttatgaccatatcaatgtggtctaaatatctagatggaaagcaaaaatatccagaagaggtttagggccatctagaccacaaacctggaacctggattgtggtttgatttttttcattttcaacctatatgttgtgtagaaatacaatttatatctgcatagctaaaggtaaagtgaaaatatgaccattatctgtttagtttgagaaatcatttttggataatatggataaattagctttaagaaacttctttgacatctgacttttccaccatttctatctgtatcaattgtattaattagataatggttaaatttttatttttttatcatgtagacatatgctttcatgcttttctgtgggtgaaagttgaacaattgctagctgatattatgtggaagttacaggttaaagtagaaccagaaattttaatataatctgatcaggttccttagtcccattcccatgtgaatctgaactttgaatttgaatctgaaaggcctacttatttgggccattttttgttggaacttgtgattgtaactcacagatgtttcagttcatattagaataaattgcccaatctataagagagtgtttaatcattggaatgaatgtaaatctgattctgatttggttatttatttgataacatttgagaaacagctaatgtggcttgacatcaatacttattaatgtcttcaacctaataatacaattggtgtcatgtatgaatgcttagctgacaataagaatttaatcaactttatttggagacaatgacttatcaaggaggtcctacccatttgtggtagggatatttcccttacagttgtgattacaagggattgtttctatagagagatgaacagcaacaacagtgacaatgatgacaacagaaaaactgacttttgaacttgagtatatccaatagatagaagaaaaaagatattagaattcatggaaattttgttttgcttttctatcaataaaagagttttcttgttaa

SEQ ID NO: 118125 - DNA, 795 bp, Homo sapiens
  Payload ID: 3115
  Gene Symbol: C11orf88
  Gene Name: chromosome 11 open reading frame 88
  Uniprot ID: Q6PI97
  ENST ID: ENST00000332814
  CDS Start-End: 1-591
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagacaaggtctcactctgtcacccagaatgaagtgcagtggcatgatcatggctcactgcagcctcaactttctcggattcaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttcta

SEQ ID NO: 118126 - DNA, 712 bp, Homo sapiens
  Payload ID: 3115
  Gene Symbol: C11orf88
  Gene Name: chromosome 11 open reading frame 88
  Uniprot ID: Q6PI97
  ENST ID: ENST00000375618
  CDS Start-End: 1-510
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttc

SEQ ID NO: 118127 - DNA, 3099 bp, Homo sapiens
  Payload ID: 3115
  Gene Symbol: C11orf88
  Gene Name: chromosome 11 open reading frame 88
  ENST ID: ENST00000529167
  CDS Start-End: 1-537
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagacaaggtctcactctgtcacccagaatgaagtgcagtggcatgatcatggctcactgcagcctcaactttctcggattcaggctaaaacaagagaagagattctccaactcttaagaaaacaaagagaagaaaggatctcgaaagaactgatttcccttccgtataaaccaaaagccaaagaacacaaagcaaagtaagtttacctatgtcaaaaatattctctcacctttcaacttactgtgtagggaagcatttcttttttcttactttgccacttacccttaaatcttctagaaacccacccgtgtattacagatttcttgccttgaataaactttcttctccgcacagctattaaagcctgtgtacgaacttgtctgtctgtggaatatgcaagcataagttagtgcaaaatggaaagcagctcagccttgaagctctgtgcacattctctgtccctctcttctcaccctgggctatataatcacccatcatcatgccctcctgactccactgtcccctatccacacctggcccacttctttagtgaatcagcacgtgtttgtggctcaccagctctgagtgggctaaggttgctaaaactaagttcatgtagcaaactctcaatgataagggagtagccttatctctggaataatgttagagcaggactaggaacagtttaacagtctagaagagtttaaaggaaataagtaagcaacagttaatcactaacgcacccctaataagaaatctgtccgtttttgtattatgactaaaaaccaatgtggccaactcaacattaatatgacaaatatttattttcataccacattctgggagaaacagaaagtgatagaattttgatttttctctcattggtattgaggctaactgcctttaatgctgtcaaagtaacacccttaaggaagaaagaatatgtctactctaattttgtaaacttctggaaaaaaaaatagaaagatcatttaatcacctagctatattatctacacaatgctcagcaacctaatttctcgctttttagccagacgatttgacttagcttccacagatgaagcaaaactagcccaatcaagagtgacttaacgataccaatagtggatgaagactgctacttaaatagcatcaatagatacgtctgggtgccttagatttccgcatgtatttttacagaacattcctgctactacccatgctgactcacctaataataaaacatttcccggcttggacagataattctcttaataatttaaatgcttacttaattccttttgtaaactaactttgtcctacatcctgaagccttgaatttcattctattctgttgtgattatcttcctactattaacttcttctagctactcttctttttttttttgagacggagtctcgctctgtcacctaggctggagtgcagtggcgcgatctcagctcactgcaacctctgccacccaggttcaagcaattctcctgcctcagccttccaagtagctgggattacaggcgcccaccaccatgcccagctaatttttgtagttttagtagatacagggtttcaccgtcttggccaagctggtcttgaactcctgctcgtgatccacccatctcagcttcccaaagtgctgggattacaggcgtgagccaccatgcctggcctctagttactctttgtacattctttgggcaactaatcatgcattactctgtgcccatattttataattatttaactcttattattgctttcattatttaacttttctcatattttttgtattgtctgtaactatactgtaagctccatgaggaattgggtcacccaaagtgccagcatactgcttacatgttggacttcagaaaatatttataacaaaaagtttagttgaaaaatatcatgtaattcagtgttagccaatttagaaagtgatgtttgcatactatacattaatttataaactttaaaaactattctattagacacaattgtaaaataactcccctacatacacagactcccccttaccattcctccttcaacaggtcttcttagtataatccaggtccccttctgttagaaagaaggaaccggaaaatgtgttcatagtaaggttttagtagcaatatatttattatccatcccagaatatttgcattttaaaagaagtctgaataaataaaataatgggtaaaccaaagaaatcaattaccaatgatgaaatctcaggagtctgactctagaataaacaaaacatatttggggtaggagggctcctgtacctccaaaccacacttcacaatatcataaccacttctctcacatacaagtttatacttggttgcaaaacccaacacatagaatctacaacagtgaatttttattgggagaattttcaaaagttgttttcatgctacatcatgttcacaatggcggagttctgtgtattggaactgactgatattactaccaacaggaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttct

SEQ ID NO: 118128 - DNA, 624 bp, Homo sapiens
  Payload ID: 3115
  Gene Symbol: C11orf88
  Gene Name: chromosome 11 open reading frame 88
  ENST ID: ENST00000529661
  CDS Start-End: 1-90
aatagagacatctttgccgaagccctaaagatacaggaatctgaggagaaagtaaagtatctccaaaagattacaggcaccatagtgtagtagattttggagacaacaagatgggtttggaagcctaactctgccacttactatttgtgtgaccttgagcaagtggtttaactcctgggatgctcagcttcctcatatataaaaagagaaatgattttttttaatatcctcctcatagagtgatgtaaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttcta

SEQ ID NO: 118129 - DNA, 811 bp, Homo sapiens
  Payload ID: 3116
  Gene Symbol: C11orf91
  Gene Name: chromosome 11 open reading frame 91
  Uniprot ID: Q3C1V1
  ENST ID: ENST00000379011
  CDS Start-End: 62-643
cggggcctgagcgcgcgtctcccggcgcggggttcctcccacgcagaccctcattcaaacgatgccaaaggggcggcgcggcagccacagccccaccatgagccagcggtcggctccgcccctctatttcccgtccctgtacgaccgcggcatctcctcgtccccgctcagcgacttcaacatctggaagaagctcttcgtgccgctgaaggcgggcggggcgccagtgggcggggcggcgggggcccggtccctgtcccaggcgctccccgccccggcgcccccgcccccgccaccacccggcctgggtccctccagcgagcgcccctggccctcgccctggccctccggcctggcctccatcccctacgagcctctgcgcttcttctactcaccgccgccggggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagctacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaa

SEQ ID NO: 118130 - DNA, 291 bp, Homo sapiens
  Payload ID: 3116
  Gene Symbol: C11orf91
  Gene Name: chromosome 11 open reading frame 91
  ENST ID: ENST00000531145
  CDS Start-End: 1-212
ggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagcttcttagggctctggaccacgtgtgctgatgcgggcaggatccctcagcctacgagctgaatgactcctccctgttggaggacacattcctgaaggcgctaaaagacgaaaagttacaaggactgaagaccaagcaacc

SEQ ID NO: 118131 - DNA, 369 bp, Homo sapiens
  Payload ID: 3117
  Gene Symbol: C11orf94
  Gene Name: chromosome 11 open reading frame 94
  Uniprot ID: C9JXX5
  ENST ID: ENST00000449465
  CDS Start-End: 38-334
agcatagggacgacaggagccaggacccgtgtaggagatggttctcgccatgctgggggctctgcacccccgggctgggctcagcctcttcctccacctcatcctggcagtggcactgcttcgctcccagcctctgaggtctcagcggtctgttcctgaggcattttccgcccccctggaactctcgcagccactttccggcctggtggatgactatggcatcctccccaagcacccaaggccgcgagggcctcgacccctcctgtctagggcccagcagcgcaagcgggacgggcccgaccttgccgagtattactatgatgcacacctatgacccaaggccctcataaagataccatgtgtgacaaa

SEQ ID NO: 118132 - DNA, 827 bp, Homo sapiens
  Payload ID: 3118
  Gene Symbol: C11orf95
  Gene Name: chromosome 11 open reading frame 95
  ENST ID: ENST00000445014
  CDS Start-End: 1-827
caacagctgggatgcacacctggggctgggggcctgcggagaggccgagggcctgggggtccagggggctgaggaggaggaggaggaggaagaagaggaggaggaggagggggccggtgtcccagcttgcccgcccaagggcccaggcaaagccccagctggtgggggctgccggcgccagcggcgagggggcccagtggcaccccgggctcggcgtctgcgcctctcagcctcccggagggccgggggcagcagggggctgggggcccggcgcctggagaggaggctgaaggagtccctgcagaactggttccgggccgagtgtctcatggactatgacccgcgggggaaccggctggcctgggggggccagcccgaggcgctgtctgagctcacccagtccccaccaggcgatgacctcgccccccaggacctgaccggaaagagccgggactcggcctccgctgctggagccccctcctctcaggatctcagccccccagacgtaaaggaagaggctggctgggtccctgagaggcccgggcccgcagaggaggaggaggagctggaggagggcgagggcgagagggcgggggtcccgggccggtcgccgcggggccgcgcccaccgccgccacccccaggagcgctggcggctggagtacctcatggagttggacggcggccggcgcggcctggtgtgcggggtgtgcgggggcgcgctggcctcgctcaagatgagcaccatcgagcgccacatccgccggcgccacccgggctccacgcgcctcggcgggcctgtccaggccctcatcgcccgggagtgga

SEQ ID NO: 118133 - DNA, 5716 bp, Homo sapiens
  Payload ID: 3118
  Gene Symbol: C11orf95
  Gene Name: chromosome 11 open reading frame 95
  Uniprot ID: C9JLR9
  ENST ID: ENST00000433688
  CDS Start-End: 154-2190
gccgagcgagcagcctgccgtccgtgcggccggccgccccgtgcatgcgccccgcgccccggggccccgcgcagcgagcgctccgcgcgggctgccgccggccccgcggccccgcgccccgccgccccggggccccgctccgcagcgcagcgcatggagcccggcggggaccaccggagccggagcagcggcggcaggggcggccccgggccagcagtggcctcggcacggggccgacggctgccgcccgccggatcgagcggcagcgcggagccagaggaagacgaaggcgggcaagatcttcagctggaagggggtgccttggggtcctgggggagtgcccccctgccctcctccagggccaggggaccagcatcttcaggcaggaaatattcagaccactgtgaggcccgggcctcgaggcctggaaagagccgcatccctggccgtgaccaccggcgctactaccacgaccactggcggctggagtacctgatggacttcaaccctgcccggcacggcatggtgtgcatggtgtgcggcagctccctggccaccctcaagctcagcaccatcaagcgccacatccgccaaaagcacccctactccttgcattggagtccccgggagaaggaagtcatcagcaacagctgggatgcacacctggggctgggggcctgcggagaggccgagggcctgggggtccagggggctgaggaggaggaggaggaggaagaagaggaggaggaggagggggccggtgtcccagcttgcccgcccaagggcccaggcaaagccccagctggtgggggctgccggcgccagcggcgagggggcccagtggcaccccgggctcggcgtctgcgcctctcagcctcccggagggccgggggcagcagggggctgggggcccggcgcctggagaggaggctgaaggagtccctgcagaactggttccgggccgagtgtctcatggactatgacccgcgggggaaccggctggtgtgcatggcctgtggccgggcactgcccagcctgcacctggacgacatccgtgcccacgtgctggaggtgcaccctggctccctggggctcagcggcccccagcgcagtgccctgctgcaggcctgggggggccagcccgaggcgctgtctgagctcacccagtccccaccaggcgatgacctcgccccccaggacctgaccggaaagagccgggactcggcctccgctgctggagccccctcctctcaggatctcagccccccagacgtaaaggaagaggctggctgggtccctgagaggcccgggcccgcagaggaggaggaggagctggaggagggcgagggcgagagggcgggggtcccgggccggtcgccgcggggccgcgcccaccgccgccacccccaggagcgctggcggctggagtacctcatggagttggacggcggccggcgcggcctggtgtgcggggtgtgcgggggcgcgctggcctcgctcaagatgagcaccatcgagcgccacatccgccggcgccacccgggctccacgcgcctcggcgggcctgtccaggccctcatcgcccgggagtggagcgagaaggccgcccacctgctggccctggggccgccccgccccgagtccccccagggccccatcccccccggcactgccgcagcctccgacgaggggggaggggacgaggaggaggagccagaggaggaggaggaggagtggggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgcggccgcgccccccgctggccgggccgggcggagacgggggatcgggtggggccaccggcgtctgcgcggtgccacttgggtccctgagccagtcggtgcgctgcgggaagcgcactctcccatcggcccggagccctgccctccccgcgcagggcccacgttttccgagaatcctcagtggcctccacgtgttagcgccgagcgctcccggccgcaccccgcgagggggttctccgcaggccgggactgggggcgccgtcagtcagtattagggccgaaggggggccgtgcgggctctggctctggccctggctgggggcccagttccctgcagccttgcacgctggcaggcacggctcccggcttgggggctgctggctgcccttccctaattgggattctcggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgcttacccctaaaccaagtccgtgggagcccggggcacaggcggtcccggcagtcagccttcgattcccgccccatccccatccccctttgtccgcggtggatgcggcgtccgttctcaacccgcagggcctggggccgggcctcggcctcttttccccgtggcagccgcaggccctgtgtggcagggatggggccccgcgatctcccaggcaggtccgagagggatgtgtagattcattctcctgtggagaacaggtggccccgagatcaggcccttttttgctctttgtattttattttgaaactgtatttaatgcttttatatgaaagggggaggggcggggacagagctgacccagtcacccttatgtgcaaatgtcttatttattatgcgtgtatcagagataagctgtgaggtggtggagggaggacctgaaggaaggaggagcgagggcagaggcggggacgggaggaccccaactagctgtgctgatgttaatcccgctgggagactccgggccctactgtctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacactgccttgggatgagcacactgagctctgcagggcctcagctggaaggcgccatccaatcgtccttcccctccccagcagaactccagaggtggggcggctgccgcagggcccaaggctgcctcggcagggggctttgtgctttttgttgtggaggccaccagggattcaggaagatcctgaatgggttgtcaattgactgaaaagtaaattcccagtgagtttgaacctccacggtttttgagacagtattaaaagcttgagaacggagattatggatggcaccaggctgggcactgccattcttttactttccttcatgcattttttcggatccagagtattaacaccactttttttactctgcccattcaaaaacagtaggcaaattgggggaaccaatttataatcactcaagcccactgccaaagttcggataagccagggcagaggggttagattcccccccctccgtaggcagagagaggcctcaggagagtggacatctttactgagacagccccaaacacaccagtggctctcaaagtgtgtccctgagaccagcagcatcaccttaggaatctgctagaaataaaaattcttgggccataccccagggttactgaatcagaaacttggttggggcctagcagtgttttcatgagccctccattgatcttgatgcagctgaagtgccgggcaccagtgaaagggaagggctgcggtagtgattccattgattcctgctttgatggaagttatggcctcacaggttagacgttgcaagttgagttggccctcttgcctaggtgtgcctccttgccttgggattctgacatgaacaggtgaagtctcttcatgattttttttgttgttgttgttaatggtatgcttgctattatggccaatatgtaaatgttactctgaatacatatttatataccatgttacttagtgacattattcaaacatttgtatgcgtatttgtgaaattgtttgcatcagtcatttaaaaaatatttcagcctaagttttctaagaggtatgttgaatacatttttaaaagccagcttaagggtcacagcagccttagtttaggagaagagctaatcacaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccacagtca

SEQ ID NO: 118134 - DNA, 390 bp, Homo sapiens
  Payload ID: 3118
  Gene Symbol: C11orf95
  Gene Name: chromosome 11 open reading frame 95
  ENST ID: ENST00000546282
  CDS Start-End: 20-163
ccgctccgcagcgcagcgcatggagcccggcggggaccaccggagccggagcagcggcggcaggggcggccccgggccagcagtggcctcggcacggggccgacggctgccgcccgccggatcgagcggcagcgcggagccagaggaagacgaaggcgactagcctggatccagcgctggaaggatgcttagagaccagccagctagccagtgtcgttgcagacaaagaagctcaggcccagagtgcggacatgacctatcaaaggtcacagagcaagttaccagtgaagccaggacttgaacccaggcctatgactccgaagccagtggattctatggatctacttaaataaaaactaaaacaaaaaaacttccacaagggtgacagga

SEQ ID NO: 118135 - DNA, 723 bp, Homo sapiens
  Payload ID: 3118
  Gene Symbol: C11orf95
  Gene Name: chromosome 11 open reading frame 95
  ENST ID: ENST00000338498
  CDS Start-End: 1-608
aagtcatcagcaacagctgggatgcacacctggggctgggggcctgcggagaggccgagggcctgggggtccagggggctgaggaggaggaggaggaggaagaagaggaggaggaggagggggccggtgtcccagcttgcccgcccaagggcccaggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgc

SEQ ID NO: 118136 - DNA, 1308 bp, Homo sapiens
  Payload ID: 3119
  Gene Symbol: C11orf96
  Gene Name: chromosome 11 open reading frame 96
  Uniprot ID: Q7Z7L8
  ENST ID: ENST00000339446
  CDS Start-End: 1-1308
atgggaaacaagcagccccagaaggtcacggtgcctactgggacagccctccaaggagtggtattgatcgtctccacgctgcaccagccaggtggctggatatgtggcaaggatccctgctgcagcttgaggccactttcaaactctgtacagaacgccttggcctgcaagagtaaacaagattaccaggctggaattctgttcaagaccagggcttttatatccagagattgtgggtcagatgcggcagaagactctgcttccaagggagagacttatactttaaccttggagcataagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcggggggcgggcggcgccggggaaggggccgttactttcccagagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaa

SEQ ID NO: 118137 - DNA, 1834 bp, Homo sapiens
  Payload ID: 3119
  Gene Symbol: C11orf96
  Gene Name: chromosome 11 open reading frame 96
  ENST ID: ENST00000528572
  CDS Start-End: 52-1305
agagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgcagttttccaggctcttgactttttgcaccttcggggtccaggctcccaagactcggggaggtgggggaggaggtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagag

SEQ ID NO: 118138 - DNA, 1294 bp, Homo sapiens
  Payload ID: 3119
  Gene Symbol: C11orf96
  Gene Name: chromosome 11 open reading frame 96
  ENST ID: ENST00000617612
  CDS Start-End: 316-684
tgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgca

SEQ ID NO: 118139 - DNA, 405 bp, Homo sapiens
  Payload ID: 3120
  Gene Symbol: C11orf98
  Gene Name: chromosome 11 open reading frame 98
  Uniprot ID: E9PRG8
  ENST ID: ENST00000525675
  CDS Start-End: 23-391
gaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaaggtgaggctgggacagaggtgggtgaggggaatcctggatttatttgggataatacttccttcttccctttactcagtggaagccccttcaaagccagccaggactagtgaaccacagctca

SEQ ID NO: 118140 - DNA, 654 bp, Homo sapiens
  Payload ID: 3120
  Gene Symbol: C11orf98
  Gene Name: chromosome 11 open reading frame 98
  ENST ID: ENST00000524958
  CDS Start-End: 49-420
cggcgctgagcggaagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgag

SEQ ID NO: 118141 - DNA, 1192 bp, Homo sapiens
  Payload ID: 3121
  Gene Symbol: C12orf10
  Gene Name: chromosome 12 open reading frame 10
  Uniprot ID: Q9HB07
  ENST ID: ENST00000267103
  CDS Start-End: 53-1183
tggcgcttcctcttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaa

SEQ ID NO: 118142 - DNA, 840 bp, Homo sapiens
  Payload ID: 3121
  Gene Symbol: C12orf10
  Gene Name: chromosome 12 open reading frame 10
  ENST ID: ENST00000549488
  CDS Start-End: 171-812
cattaatcccctacccggcgacacccggcagccccttcacccctgtgtacctcgcaggatgcagagattgtgcggacccgggatcccgaaaaactcgcttcctgtgacatcgtggtggacgtggggggcgagtacgaccctcggagacaccgatatgaccatcaccagagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctcatactga

SEQ ID NO: 118143 - DNA, 988 bp, Homo sapiens
  Payload ID: 3121
  Gene Symbol: C12orf10
  Gene Name: chromosome 12 open reading frame 10
  ENST ID: ENST00000548632
  CDS Start-End: 61-966
ttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctca

SEQ ID NO: 118144 - DNA, 414 bp, Homo sapiens
  Payload ID: 3121
  Gene Symbol: C12orf10
  Gene Name: chromosome 12 open reading frame 10
  ENST ID: ENST00000547864
  CDS Start-End: 1-392
gcatggtgggcaccctctatgacaaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctca

SEQ ID NO: 118145 - DNA, 2919 bp, Homo sapiens
  Payload ID: 3122
  Gene Symbol: C12orf29
  Gene Name: chromosome 12 open reading frame 29
  Uniprot ID: Q8N999
  ENST ID: ENST00000356891
  CDS Start-End: 204-1181
gaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcgtgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtcttcaagtatatacttttataataagttgaaaatttcatataattttatttattaagaattccaatctaagtataaaggtacaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttcaaactcttcagaagcagcaacagggctagttaattcaactcccaattgttctgaaagtttttttaccttctcttctaagagaatattcttcttcacttcttccttgtaattatacttaagatcttcaatttcttcaaaaaatgaaggatcaaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatctcttataatgggacttaatctttctctaaaagcatataagagcttgtcaatagagcaatcaatcaaaaagattttgtgattcataacattgaagttagtctggttaagagttttggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagaggtaaaacagcaaatatttttttaagggaactataaccttaggattcctgaaaagaatttcaaaaaaaaaataaagacactgttgccaatgtgacccaaaacttaagaacatactaatggcatatatttgttacaattaaaaaataaatttactacttaatccta

SEQ ID NO: 118146 - DNA, 731 bp, Homo sapiens
  Payload ID: 3122
  Gene Symbol: C12orf29
  Gene Name: chromosome 12 open reading frame 29
  Uniprot ID: Q8N999
  ENST ID: ENST00000453037
  CDS Start-End: 88-204
cgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcgtgtcctggtttgaagattgcaaagagggtaaaattgaaggaatagtgtgg

SEQ ID NO: 118147 - DNA, 1578 bp, Homo sapiens
  Payload ID: 3122
  Gene Symbol: C12orf29
  Gene Name: chromosome 12 open reading frame 29
  Uniprot ID: Q8N999
  ENST ID: ENST00000552121
  CDS Start-End: 114-230
gcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctgggttagggagcaagaaacatccattacatcttcttataccacatggagcatttcaaataagaaatctaccttcattgaagcacaatgatctcgtgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtcttcaagtatatacttttataataagttgaaaatttcatataattttatttattaagaattccaatctaagtataaaggtacaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttc

SEQ ID NO: 118148 - DNA, 2740 bp, Homo sapiens
  Payload ID: 3122
  Gene Symbol: C12orf29
  Gene Name: chromosome 12 open reading frame 29
  Uniprot ID: Q8N999
  ENST ID: ENST00000550333
  CDS Start-End: 145-261
ggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcgtgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtcttcaagtatatacttttataataagttgaaaatttcatataattttatttattaagaattccaatctaagtataaaggtacaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttcaaactcttcagaagcagcaacagggctagttaattcaactcccaattgttctgaaagtttttttaccttctcttctaagagaatattcttcttcacttcttccttgtaattatacttaagatcttcaatttcttcaaaaaatgaaggatcaaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatctcttataatgggacttaatctttctctaaaagcatataagagcttgtcaatagagcaatcaatcaaaaagattttgtgattcataacattgaagttagtctggttaagagttttggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagaggtaaaacagcaaatatttttttaagggaactataaccttaggattcctgaaaagaatttcaaaaaaaaaataaagacactgttgccaatgtgacccaaaacttaagaacatactaatggcatatatttgttacaattaaaaaataaatttactacttaatcc

SEQ ID NO: 118149 - DNA, 770 bp, Homo sapiens
  Payload ID: 3122
  Gene Symbol: C12orf29
  Gene Name: chromosome 12 open reading frame 29
  ENST ID: ENST00000552847
  CDS Start-End: 112-264
ggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcaggtcagcaccttttggggaaaccccctaatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatggtgagtga

SEQ ID NO: 118150 - DNA, 3826 bp, Homo sapiens
  Payload ID: 3123
  Gene Symbol: C12orf4
  Gene Name: chromosome 12 open reading frame 4
  Uniprot ID: Q9NQ89
  ENST ID: ENST00000261250
  CDS Start-End: 89-1747
ccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataaca

SEQ ID NO: 118151 - DNA, 685 bp, Homo sapiens
  Payload ID: 3123
  Gene Symbol: C12orf4
  Gene Name: chromosome 12 open reading frame 4
  ENST ID: ENST00000544697
  CDS Start-End: 195-428
tgagcggactgcccaggacttcggaactagacgagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtac

SEQ ID NO: 118152 - DNA, 2168 bp, Homo sapiens
  Payload ID: 3123
  Gene Symbol: C12orf4
  Gene Name: chromosome 12 open reading frame 4
  Uniprot ID: Q9NQ89
  ENST ID: ENST00000545746
  CDS Start-End: 118-1776
ggtgtggaaaaagtatgtcggcaagtcagctggtttcccagtgcaggacgcgctgacagctcgagtgagcggactgcccaggacttcggaactagacgagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaa

SEQ ID NO: 118153 - DNA, 1049 bp, Homo sapiens
  Payload ID: 3123
  Gene Symbol: C12orf4
  Gene Name: chromosome 12 open reading frame 4
  ENST ID: ENST00000541014
  CDS Start-End: 438-1049
tggaaaaagtatgtcggcaagtcagctggtttcccagtgcaggacgcgctgacagctcgagtgagcggactgcccaggacttcggaactagacgagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacc

SEQ ID NO: 118154 - DNA, 561 bp, Homo sapiens
  Payload ID: 3123
  Gene Symbol: C12orf4
  Gene Name: chromosome 12 open reading frame 4
  ENST ID: ENST00000542080
  CDS Start-End: 130-561
ggtgtggaaaaagtatgtcggcaagtcagctggtttcccagtgcaggacgcgctgacagctcgagtgagcggactgcccaggacttcggaactagacgagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaat

SEQ ID NO: 118155 - DNA, 727 bp, Homo sapiens
  Payload ID: 3123
  Gene Symbol: C12orf4
  Gene Name: chromosome 12 open reading frame 4
  ENST ID: ENST00000544258
  CDS Start-End: 1-144
ctttatgctagaacccagcgcaggagtaaattgaaagaatcacttgattctggaaaccaaaatggaggaaatgatgataagactaagaatgctgagaggaactatttaaatgttttacctggaactacagaaaatacaagctgatgagatttttcttggcttgtagagctacacagaaaaaagagtgatggtaggaagcatggattttaatgtttgagaaagactgctccagcgttcagccttaaatactcattcattcaacaaatacttatcgagtaccttctacgtgccaggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagat

SEQ ID NO: 118156 - DNA, 2776 bp, Homo sapiens
  Payload ID: 3124
  Gene Symbol: C12orf40
  Gene Name: chromosome 12 open reading frame 40
  Uniprot ID: Q86WS4
  ENST ID: ENST00000324616
  CDS Start-End: 155-2113
aggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatgggaaatataccttcggaagaattgcactctaagcagtcatgggactttggacttgatgagattctgatggaagaaggaggaatatattctttaaaaagcaagcgaatatctactaagaaaatctctcttgattctgcacagagtagtcggtctactagttactctccaagaccaacagacagctgtttcagttctagttcagatttgccatctgaagatgaagatcaaatatcacagcaaattgaagattcaaataggatgaccatcaaaaccaaggaaaaaatgaataatttttatgtagaaaggatggcaaaactttcaggtgacaggattgttaaaaacgatgacaaaattcacaaacagaatgagaatttctaccagttctcagtgaaaaataatacagatcagtttccacagttgcagtgcaattcagcccacattttgcaaaacaaaaccaatgataactgcgttctgcaggctgcaaggtgtgatgcagggatacaaacagagagtgaatctgtaatggaggaaaaattagatgttgccatacagtgtgatctaatttcaaaatgtacatgtagaagtgatgtttctctttgcaaccttgaaaggtgcagtggaaatattaaggcagataccactggagggcaggaaatccataagaacaactaatattctaaaatctctacctaggatgtagaatttcacttgcccttagaaaacaacagtaaatgttgaaaatttcattaacatgataagaaatgagaaaaagtagctaagcataagctgacagtgttcagggtgtatattcacggttcatgttaaaacattttaatattattaatgtatgtatttaatttgtatatagccatttccttaatagctttggtatatggtagagtttttagaaaataatatatttgtaaatgtactagcgtttttatgtgattattcagtatattacaatgatgcgctgttatttatgggttaaaatatgcttaattgcttccttccttgtagcatttattttaatattctttgcagttgcattttctggcaaaaatgttccctttcaagatatttaagatagaaaataatacctaatatattttatgtcctcattataataattttgttagctacttctctttaatattacagtcctatttaaaaattctagcattaatttgtagataacacatatcttctatttgcataacatagtttttttgttggtgctattaattcaaaggaaaatgttctgtaggattaaaagatgttttaatgtttttataaaataattgtttgaaattaaaaaatgatttatgttactaa

SEQ ID NO: 118157 - DNA, 1656 bp, Homo sapiens
  Payload ID: 3124
  Gene Symbol: C12orf40
  Gene Name: chromosome 12 open reading frame 40
  Uniprot ID: Q86WS4
  ENST ID: ENST00000405531
  CDS Start-End: 171-1604
cgcagaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatgggaaatataccttcggaagaattgcactctaagcagtcatgggactttggacttgatgagattctgatggaagaaggaggaatatattctttaaaaagcaagcgaatatctactaagaaaatctgtcagtataactgtataagttaattttactctattttaaaaactaacaattaaatagaaatcagttaaatttgaa

SEQ ID NO: 118158 - DNA, 3061 bp, Homo sapiens
  Payload ID: 3124
  Gene Symbol: C12orf40
  Gene Name: chromosome 12 open reading frame 40
  Uniprot ID: Q86WS4
  ENST ID: ENST00000468200
  CDS Start-End: 212-1396
actcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaagaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatctggtgtacaaaatgttctgagtttaaggtgatttttacactcatccattatgtgttgatgttaaatttattccttaaaagtttgagaactgccttccaggcttttctgaataatgacctgcaattataagtaactaaagaaaactttattttagctagtagtttctagctaaaatagtcctaactttcttggggaaatataccttcggaagaattgcactctaagcagtcatgggactttggacttgatgagattctgatggaagaaggaggaatatattctttaaaaagcaagcgaatatctactaagaaaatctctcttgattctgcacagagtagtcggtctactagttactctccaagaccaacagacagctgtttcagttctagttcagatttggacacatgccgtgggtatcctgagctgccatttaagaagtctagctaccctaaagcctccatgctggagagaccatgtggagggaccacacaaagattgacagtaagatgcttgagaagtcccagctttcccagccccagcgttttgggtcttctcagcccaagcactagatgtgcagccccagcccatgcctgggaaaaacttccgctattcctttgctgactgcaggaatgcttgagatgcatggacctattcatttttaaaaatttattgagcacagggtccggttccaagatggttgaataggaacagctccagtctacagctcccagcatgagcgacgcagaagatgggtgatttctgcatttccaactgaggattggacaattaaatgaggatttttctgcccactgatactgacatgttctgcactattcaggtgtccgttattcaggtgcaaagaagacaagatataaaataaggcccagaagtgcagtccaggagtatggagtagggcagaaattgaaactgaaactgtggaacgagaaaccatggataagggaggactacagtacatcaaatggaccaatcatggctttctgcaggtcctcatattatgtagcctgtcattcagggatatgtgatctgaatgacaataagaagccagacgtatgtgaagatggtggaaggacattctatgagtaaacagcaagtgcaacgtaacgttgattacaattcacctacccattactttggaaatagaatgaggtgcatctcaccaaccatcctcctgcagaaagccctctgacctgtgaaacaggaagctgtaaatgtctggaaagtatgtggattggacacatgtcttggattaaattatcttacacgccactggaatgaacctgcctgattctccactttctctgcttcattctgagcgttcttgcctcccctgggtactggaaagagaatggagccttagaatcaatgctcccaacccacccattctttttcccggcactttccacctttacaactacgcctccaaaagtttcagtctattgcagctatggtgggagccacataggaacttctcagggatgcaaaattcatgaaccacaattccctggccagaagaaccacatagacttatctattaccaggatcggagagagcgggcccctttcttcctagatttcactttttctcttaatttattctgacaatgaggagacagaaaaagctgcatgatagtgatgtagagtctaatggtgtatctctggatacacaaagagccatctcaggtaacaactttaatccttgaaatgagactattatcttcctgttaattattccattatttcctaatgtttttaataataaaaccccccaaacaac

SEQ ID NO: 118159 - DNA, 1513 bp, Homo sapiens
  Payload ID: 3125
  Gene Symbol: C12orf42
  Gene Name: chromosome 12 open reading frame 42
  Uniprot ID: Q96LP6
  ENST ID: ENST00000378113
  CDS Start-End: 266-1348
gagcgcttggaaccacgctgcgccgcgtccccaggacccagcagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtccctagcgcagcc

SEQ ID NO: 118160 - DNA, 2090 bp, Homo sapiens
  Payload ID: 3125
  Gene Symbol: C12orf42
  Gene Name: chromosome 12 open reading frame 42
  Uniprot ID: Q96LP6
  ENST ID: ENST00000547347
  CDS Start-End: 89-412
agagtgctccagctcccgcggaggaggctgcgggcggcgccccgggatagggaccctgcagctccagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaagtcaccatggacaggccacacagaaattacagggagctatggttcttcaccttgaagagtaaaatagccactatgaggagacctgctgtgagtgcatcagtctgaaactgctcacatattaacgctgactcagacccatgaagtcatcagatgtcaccactcctagaagccctttcctgcacttcctggctcctcaggtttcctgcttcatcctgcacctgccttcttgaaagaaaacaagacatcagatacttattcaaataatggaatagctgatcaactgggtctccacacaaaagagagttatccatgataaaagaacaactttttcatgcattatatgtgacacatgcatgctttctcttaagatttatgaacccatgactattagtattgttaatataatcaaaccttttacagcctcactccaaagcttaaacttattatcaattgccttctagaggggagtcaatcaatttcataagtgcttaaacacctgcactctctttgaatcggggaaaaatcaataccaagtcctcattttctccaagtatataatgcaaccaaatcttgcttacaagttcaggaggatttgtgattcaacagtcacactttaaagacgtcatgagcttgatcctgagtggtggcggttttttttttaatgaaaaattattaattcatttctggatgctaatgaaaaaacaggtcactgtcggggaaaaataaaacagactctgctaatactgcttaggattaagtcccctgtttgtgttctgcataggtgtgttttgcaacaaacacaaatcacatacctattaaccaggcatggtgccagtctctgaatatacagatgtggctgagacaggacccctgccttcaggatgctcatgatctattaatggaagaagatgtataaacagcttactccaattgttatacaaaacaataatttaattgcgtgtagggggataaagaagaggagacagagaaaaggaaagaaataagaaaagaaaaaaaaaggacagtgtattagatgcttattgctaccagccaggctagaacttccaattctataatcactcttgatttttacaatatgttgtaaaaacaaagaggaaggtgtattttcaaaatactattaatttcttttttgttatatgtttttcttctttgttattttgatacgattttgaaaagtagagtctaatataggaaggactatttattcatcacaataacaactaaagtttatgtttttccttctctgcttcagattttgtttaaatataagaactggaaaaccaaagctttgtcatctctaaaacaccttcactgagaaacgaagtgtccttctcatcccatggggctgttctgggtatcaagtgactgtttagcttggccatttgctgctcctacctcaaatagaaggtttcctgtgactttctttgtccaacggaacatgatagaactaacgtagcaccagttaccaccttggtcctcaagaggccttccaccctttagctctcttggaatccttccttccccaaaggaacaagtctgcactaaccaatgaaggatgagaaagcacaaggaggagagccaaggcaccccagtaactgcagaagcagagctgttgacagatgcatgggggagtccagccaagaccagaattgccatgctgagtgcagtctaaattgccaaatttcagattcaggaataaacaaatgaatttttattgca

SEQ ID NO: 118161 - DNA, 831 bp, Homo sapiens
  Payload ID: 3125
  Gene Symbol: C12orf42
  Gene Name: chromosome 12 open reading frame 42
  ENST ID: ENST00000552578
  CDS Start-End: 209-831
ccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaa

SEQ ID NO: 118162 - DNA, 1336 bp, Homo sapiens
  Payload ID: 3125
  Gene Symbol: C12orf42
  Gene Name: chromosome 12 open reading frame 42
  Uniprot ID: Q96LP6
  ENST ID: ENST00000548883
  CDS Start-End: 89-1171
agagtgctccagctcccgcggaggaggctgcgggcggcgccccgggatagggaccctgcagctccagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtccctagcgcagcc

SEQ ID NO: 118163 - DNA, 1532 bp, Homo sapiens
  Payload ID: 3125
  Gene Symbol: C12orf42
  Gene Name: chromosome 12 open reading frame 42
  ENST ID: ENST00000548048
  CDS Start-End: 498-1379
agtgctccagctcccgcggaggaggctgcgggcggcgccccgggatagggaccctgcagctccagggagttgaacttgtcaaattaatgtctacagtgatatgtatgaaacaaagggaagaagaattcttgctaaccatcagaccttttgcaaacaggatgcaggtagtgaccttcagtttataagaagaaaagagttttgaggtgtgattatggtctcctaatgtctctgagacacagtttcccaatctagaaaatggaaataatggtatctccctggatgaatgctgaaatccccttgctatattcccattgtgagcagtgccaccctgtgggatagaagcacacccagtgcaaagatcaagctattgaagcttagggaggtgaagtaattttcctgggatcacatagccagtaaatggtagaggcaggattccaactcagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtc

SEQ ID NO: 118164 - DNA, 1557 bp, Homo sapiens
  Payload ID: 3125
  Gene Symbol: C12orf42
  Gene Name: chromosome 12 open reading frame 42
  ENST ID: ENST00000551134
  CDS Start-End: 227-499
agcagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaccatttcactgacctgaaaggatatatttaaatgtgcctgtccaatttactacctaagagataatgaagtttttaggacaactgataaagcagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtc

SEQ ID NO: 118165 - DNA, 4469 bp, Homo sapiens
  Payload ID: 3126
  Gene Symbol: C12orf43
  Gene Name: chromosome 12 open reading frame 43
  Uniprot ID: Q96C57
  ENST ID: ENST00000288757
  CDS Start-End: 14-802
gcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcatggccagggatggtggctcacacctgtaatcccagcactttgggaggccgaggcaggtggatcacttgagccgagttccagaccagcctaggcaacatggtgaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgggtgacagtgagaccctgtctccaaaacaaaatttttttaaaaagtagaagcttgaggttaagatgaaatctggctttgtcattagagtctcagcagagcaagaaaagcagagatgtggggtgtgagagcgtgggtgctggagcctgtctcctcttcgcaggcctctggcctgccccagcctcccgctacctgcccaaaccccatctgaatgatttgtggacaagcaagaagtttccaccgcatttctccttgactttactaaaagttaaataaacgtgccactcgccccggctggctacaagctgcagggggtgccgggtcaccccaggccttttcctgaatcccagggtagacgcggtacactgaaggccaggttctcagcagcaggcccagggatgtgggaccatgcttgtcctgggttcacaggctcctttgtccctcctggcagtgctcaggacctcagactcctcagggtggctgcgaactgccctcagccagccaggcccccaggcttctgagtgttagtcctgtccacacaggtagctcctgtgccctggggtcacctctttcttctcctgggcacctcagcttggccagttccccggccctgctcagctgctcgggccttgctgccttgtgagctcagctactcctgccccaaacaagggcagggtctgcagggcgctcgagacagaggagctgccccaccaggacctggacttggcacgggttgcgaggctcccacaggagtaaggacgacttcccagccccgaagtagccttcccagtagaggcaggaggccaggctggcctcagaggcatgatgctcttgggaacaaatacaggaaagctggaggtcatggggcctgggagagggaatcgctggggatgggaagccaggagagccctgcctgccttccctgttagcttcggcctccctgggctcaggcgttagagccccaggctctggcacagagtagccacccaggaaatgcctgtgtgagtaggtgatggggtcagtacaaatggcatgtgggtcactagctggaaggagttggggcaggaaggagtggcccggtgggtacattggtgacagaacaaggccacgctgatccagggcctctcagagctcagcaggtcacagctacacaggcctgtgtcctgagaagtgtggctgccagagtggtgtagcggtcccagggctctccataggcccaggctgggggtgcccaagtcataggccgcccccttcagttccaagtaagaagactgtatcccacgaagcagcgacagtccctcctacatctgccatgaacaggctttgctcctagctctccacgaccccctcctgtgcaccccgagcagcctccacgggttggggcgcctcagagccctccctttctgatgcatcagagcagagtggggagcgaggcacagctgtccaggaagggccacggttgctcggcaggctcaggtcctccaggcagggctggctgctgccctcatcaccccccaagcaggcagtacaggccccagggcccaggtgccgtggttactgggaggaagaggccatctgggtggagatgaaggtctcgatgacgctgtggttggatggcagcaggtggctctggccattgctggagtctgagctctggtacagcaccaggctgctggaggacactgcagaggcaaacaaggctgctagccacccaccaggcacccacacccaccccacctgcctgtccctaggggtactcaggatggggaggcagggccacacctcctggatcacagcagataacaggaaccccaaagtcacacctctaccctcggttcttcaaagggagcctcccagccagggtccacggccgcccatggagtggcctgagtacatcttagtgtgaacactggagaagccccggtgagatgccgaggtaggtagttgtacgtgttggcttggctaggctgagtcaaacactaatctaggcgctgctgtgaatgcaggtgctttgtagatgtggttaatgccacaatcagttggctttgagtgaaggagattaccctgaaaatatgggtgggcctcctacatcagtggaaggccgtaagagcaaaaaccggtttcccagagaaggaattctgcctcaaggctgcagaattcactccccagagctgccagcaacagatttcaggcctgccagccccccgcagacacgggccaagtccttcaaataaatctgttggttctgtgttcctggagaa

SEQ ID NO: 118166 - DNA, 2397 bp, Homo sapiens
  Payload ID: 3126
  Gene Symbol: C12orf43
  Gene Name: chromosome 12 open reading frame 43
  ENST ID: ENST00000445832
  CDS Start-End: 1-666
atgttctgtcaaaacccaggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcatggccagggatggtggctcacacctgtaatcccagcactttgggaggccgaggcaggtggatcacttgagccgagttccagaccagcctaggcaacatggtgaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgggtgacagtgagaccctgtctccaaaacaaaatttttttaaaaagtagaagcttgaggttaagatgaaatctggctttgtcattagagtctcagcagagcaagaaaagcagagatgtggggtgtgagagcgtgggtgctggagcctgtctcctcttcgcaggcctctggcctgccccagcctcccgctacctgcccaaaccccatctgaatgatttgtggacaagcaagaagtttccaccgcatttctccttgactttactaaaagttaaataaacgtgccactcgccccggctggctacaagctgcagggggtgccgggtca

SEQ ID NO: 118167 - DNA, 1033 bp, Homo sapiens
  Payload ID: 3126
  Gene Symbol: C12orf43
  Gene Name: chromosome 12 open reading frame 43
  ENST ID: ENST00000539736
  CDS Start-End: 14-772
gcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccaga

SEQ ID NO: 118168 - DNA, 645 bp, Homo sapiens
  Payload ID: 3126
  Gene Symbol: C12orf43
  Gene Name: chromosome 12 open reading frame 43
  ENST ID: ENST00000535367
  CDS Start-End: 81-645
gggaagccaagagccggtagggtactatgtttggggagactggctgaggggcgtgggatcttcccctggagcctgagaggatggatggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttg

SEQ ID NO: 118169 - DNA, 585 bp, Homo sapiens
  Payload ID: 3126
  Gene Symbol: C12orf43
  Gene Name: chromosome 12 open reading frame 43
  ENST ID: ENST00000538296
  CDS Start-End: 1-585
agcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaag

SEQ ID NO: 118170 - DNA, 1270 bp, Homo sapiens
  Payload ID: 3126
  Gene Symbol: C12orf43
  Gene Name: chromosome 12 open reading frame 43
  ENST ID: ENST00000537817
  CDS Start-End: 29-910
tctccacaatcctttgcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggtactatgcactttgggttcaagtttcacttattcaacaaatactgatcccctgcgtgtgccagatgctaggcttcacgcctggcatttccaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggca

SEQ ID NO: 118171 - DNA, 1339 bp, Homo sapiens
  Payload ID: 3126
  Gene Symbol: C12orf43
  Gene Name: chromosome 12 open reading frame 43
  ENST ID: ENST00000546272
  CDS Start-End: 14-214
gcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccgtagagatggggtttcaccatgttgaccaggatggtctcgatctcttgacctcgtgatccgcctgcctcagcctcccaaagtgctgggattacaggcgtgagccaccgcgcccggccttgactccatcttaaaagtgcatctatctggagttcacccacttctcaccacatcaattactgcagcagactccgtgttcctgcctttgccccaacagtctcacgctgcacagcagccaaagatgttctgtcaaaacccaggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctca

SEQ ID NO: 118172 - DNA, 459 bp, Homo sapiens
  Payload ID: 3127
  Gene Symbol: C12orf45
  Gene Name: chromosome 12 open reading frame 45
  ENST ID: ENST00000280749
  CDS Start-End: 15-218
ggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtccctgatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaaa

SEQ ID NO: 118173 - DNA, 1131 bp, Homo sapiens
  Payload ID: 3127
  Gene Symbol: C12orf45
  Gene Name: chromosome 12 open reading frame 45
  Uniprot ID: Q8N5I9
  ENST ID: ENST00000552951
  CDS Start-End: 44-601
tttttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaaacaggtgacatatgtctgcaaattctgtgaaaaagaatgtgattcacgggttcttttgcttttcaggcacctatggtgcttttatatgttaaaaactttagacaagttaaatttgacagagtttctttgggcaaagaatgattaatgagttaggtagcattgtaaactgaaaggggttcagagacctccgctctacagcaaggaaagtgtgcttttatcagctgaacacagaagtagagtacaggaataacttgatgggttacagctaggtgtttgcctaaataaggcaaagaggagacctaaggctgcctgatgtcccataggtatggtctgatctaaggagatctaaggctgccttgtccgatgggctgaggcttggctgtttgtgattggccagacttggctatttgttataaaaatacactcctgagttaggttttggtgtgtagagtacaggaataacttgatgggttacagctaggtgtttgcctaaataaggcaaagagg

SEQ ID NO: 118174 - DNA, 588 bp, Homo sapiens
  Payload ID: 3127
  Gene Symbol: C12orf45
  Gene Name: chromosome 12 open reading frame 45
  ENST ID: ENST00000622317
  CDS Start-End: 17-580
caggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaagaaatagtcaaataaattatctg

SEQ ID NO: 118175 - DNA, 8404 bp, Homo sapiens
  Payload ID: 3128
  Gene Symbol: C12orf49
  Gene Name: chromosome 12 open reading frame 49
  Uniprot ID: Q9H741
  ENST ID: ENST00000261318
  CDS Start-End: 162-779
gggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagctgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttttttttgcgatggagtcttgctctgttgctcaggctggagtgcaatggcgtgatctcagctcactgcaacctccccctcctgggttcaagcaattctcctgcctcagcctcctgagtagctgggatcacaggcgtacaccaccacacccagctaagtttttgtacttttagtagagacggggtttcaccatgttggccaggctggtcacggactcctgacctcagatgatctgcccgcctgagcctccgaaagtgctgggattacaggcgtgagccactgcgcccggcatggagctgctattgatgggtgagctccacagcttttgcagaagcagaggatatgacttgagagcagtgctgtcacctctcagcatgtccccaagcccaactggggcctcctggagatgcctcagtcggcactggccccaagggaatcgtggggaacagttgcacaatttgcaagtttctgagtgcagcttttcccatccttgggatcagcagataagttgtaaacacagggaggtactgcttattggatatacttttcataagtaggacagaattcttttgggactctagagttgggaactaccacttactagcggcgtggctgaggcagtcttcctcctctgtggctcaggcccttcatctgtgaaatggggtcacagcatctgcctctcagggtcactgtgaggtgtcgatgtgagcaaggcctgaggcttggcaagaagtcaatgtctgcaactcagcagggagcaatggcaggggcagtcaggggtcggctcggataggggtgggtgggctcctgaggttggaagggtaggaattacagagctcttgttactattgttgttactgtttttaaagatacgatatttcagataattcaggagcacgtaaggatgaaacttaggataacctaaaatcacacaacctagagagaagcgcatttttgtcttcccccattttctaggcaaaaatgaaagtactttgtcctcttgaaaaacaattctctaatgaatatcctatgttacatagaggcctgtgtaatgcatttgtgtggccacatggtgtcaatttcatgaatatacaataatattattaattccctgctgaggacattaactggtttccaaggctgcttgttgtttttgctactacaaataatgcattgatgataaatacttttacatacatggttgtatgtttatctgaactattttcaccaatatattcacctagtgtgtatggaagtgtccatttttgtcatacccctggtaaccctgtgatattatttttaaacattttgctaatggatctctgttcttgtttgaatgtatttaatttccagcagaatgagccccattccttattttgattggccatttatcatgtacatatggtgaaatgcctattcgtgacttagccaatgttgtttctttttcttactgattactacagtacatttttatatgaaagcagcctttgtccccttctcttgtttttcagccctgtgttagaaacaactaagctcacatattcacaaaccaacttttccagttcatctagggcagtggtgctcaacaggggcaattttgccccccagggaacatttggcaatgtctggagacatttttgtcacaggtggggaggagggcagtactgtgggcactcgtggagggaggccagggatggtgcccaacagcccccacgacacagaattacctggctggaagtgggagccgggtggagggagggaagccctgctctggggtcatatctccccgttagattgaacagaggagctcctggtagctgagtgctgacttcattatttttccccgcccttgctttctaccctgctgaagtgctgctgattaaattaccctgaaatccccacaggacacattacttcctcacaggtctctactagcccagcgctgcctcaaggaatggcattattcctttgccactgtgtcctcaccgcactcttggactccgccgaatgcagacaccctcctgtctgcagaaggatctggaggggtagaacgcttcccctctacgacggattgactccccagcacctcaccagcagttctttgaatggagtggctttggaggtgggagttgaggaagaaatgtgagcctgtcattacaggttctgtttagaaaactagtcattctactaaaaaggtatcacataagtaagtaggagcaataaaaacaaagaagatagtgggactccgagaagctttccccgcctctggcctgttagtctatcgttcgttgggcaaggctcttccagtgtgtgaccttttgcgtgttatcacagcatgagtgcagttttgtgtacaggcatccctatattcagcatgtatctgcaacatgccttacctcgtctgctgtcacagagcaaagtggagcaagtggtcgccgttggtctgcacctgagctgggagccgagtggtgacgtgcatatgggccgactgcgtctccacagaacctactcagtgatcttcctgtgtacgactcagtccctgatgttggagttgaactgtaggactgtctgtaaaatgaaagtgcagactttaatgtagtaaagagaatgacttgccagttacaaccaatgagcaaagcagttaattattcaaatattttaccaagagtccaggtttattttttctcaggactacacattctgtgagaccagagggaccaagacatatcactaccagaaatgtgttttcatcagcactgccagaggttttcatagggtagtttactcttggaatttttaaattcatacttttttttatgcaacgtggggtaggtaagcttctgatcactgtgcacccagattatcccaaaatcgaaagtggtgttggcagccgggtgtggtggctcacacctgtaatcccagcactttgggaggccaaggtgagaggattgcttgagcccagaattcgagaccagcctgagcaacatagggagaccctgtctctacaaaaaataaaaaaaaggagccaggcatggtagtgcacacctgtagtcccagctactcaggaggctgaggcgggaggatggcttgagtccaggaggtcaaggctgcagtgagccgtcattgcgccagtgtgctccaacctgggccacagagtgagaccctgtctgaggaggggaaaaaagtgttgtctaaatgagaaatcaccattatcagtaatttaagattccaggctatgttggtcacatctcactattcttttttttttgaaacggattctcgttccatcgcccaggctggagtgcagtggcacgatctgggctcgctgcaagctctgcctcctgggttcacgccattctcctgcctcagcctcccgagtagctgggactacaggcgcccgccaccgtgcccagctaatttttgtatttttagtagagacggggtttcaccgtgttagtagccaggatggtctcgatctcctgacctcgtgatccgcccacctcggcctcccaaagtgctgggattacaggagtgagccaccgcgcctggccacatctcactattcttaaggaagagagagagcgagagagagtgttgtcctgtcctgtggggattggggcattgtattaagttgtactgggggatgtcaagatagaaatgttgagtaagttactacctgaataaatatttgaccagttgatgctaatttgaatagtaaatgtgatgacattatatattctcagggatgtttccatacattggctctgtgtgtgcgtgtgtgtgtgtgtgtgtgtgtaacaaaagcagtatgaagtatgtgagcaatatcctaattttattgacaagagcactgaccttaatgaccttgagtaaattaccctctccggctttggtttcctcatttgtcaattaagggtgatggctagcgtatcttgcagatccaaattccaatttttgtaacaagccaaaagtccccctggctgttaaagcaagaccagagccctcgtatcccagcggctgggtcccaggcttttgattttcacaggacaaatgtagcccagccatctggagcccgtttttctccaaaccagggcttcctccttctctcttgcagatttcaactggggctcaccattttctgcctcttcctcctccagttttaaagagacaccatatccttctctgctgggaccaacttcccatgtactgctgccctgcacctgtgaaaacagctgctgtgttttctgtcataaaaatagctgccttttggcagagaagcacacaacggtactacgtttctgagccttaatgcagtgctcaattatttaggtgtgcttcacctgagatacacagagcatcttggaactcctactaagcagggcttctacaggcattgctcagctcagtaaaaggttttcctttctctgcttttgtgattaccaggcagaaaccttaaaatgtatgaacttacaaagaaattaaattgtgccaaattagattcccagcccctagagataaccactaattaaagttccgctggagcgttttgcctgtattttgtatataaacgtggattttgtatttgtatgtaaataaaggtaggaccctgctgtccata

SEQ ID NO: 118176 - DNA, 1371 bp, Homo sapiens
  Payload ID: 3128
  Gene Symbol: C12orf49
  Gene Name: chromosome 12 open reading frame 49
  ENST ID: ENST00000547630
  CDS Start-End: 171-314
ggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattt

SEQ ID NO: 118177 - DNA, 492 bp, Homo sapiens
  Payload ID: 3128
  Gene Symbol: C12orf49
  Gene Name: chromosome 12 open reading frame 49
  ENST ID: ENST00000547606
  CDS Start-End: 1-131
tcttcgggctgtcgctcgtctacttcctcagcagcaccttcaagcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatcca

SEQ ID NO: 118178 - DNA, 923 bp, Homo sapiens
  Payload ID: 3128
  Gene Symbol: C12orf49
  Gene Name: chromosome 12 open reading frame 49
  ENST ID: ENST00000548356
  CDS Start-End: 309-449
gttcccagttgcttgaatggttcttttgcagaatggatcattgtattgctaatcacatatctaatgaataagatacccagggtgttttggcatgcacgtgtgtgcacgcgtgtgtcctttcccctccctccttttctcctcctcttccccccttccctgtatcagcattctcttagtttaggagagatagccaaggtcaccttgtgctggcttaggtaatttattacaggcactaacttttgtttccatagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaatta

SEQ ID NO: 118179 - DNA, 1722 bp, Homo sapiens
  Payload ID: 3129
  Gene Symbol: C12orf50
  Gene Name: chromosome 12 open reading frame 50
  Uniprot ID: Q8NA57
  ENST ID: ENST00000298699
  CDS Start-End: 182-1426
aggaaaattctagaagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggaggtgactgttatgttccacagagggtcatatttcttggagtcgatgaaagtgaagctttaactgaagagaaagaaatcaccatatcaaaatgttcaaatactaaagataacaaggacagtcctcatccaaagcattccctaactacccgactagtacctacaacgcatgtattaaatgctactgagaatatcagtatgaagtgcagagaggacccctcttcaatgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaattaaaa

SEQ ID NO: 118180 - DNA, 1525 bp, Homo sapiens
  Payload ID: 3129
  Gene Symbol: C12orf50
  Gene Name: chromosome 12 open reading frame 50
  ENST ID: ENST00000550553
  CDS Start-End: 189-1316
aacaatgaggaaaattctagaagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggaggtgactgttatgttccacagagggtcatatttcttggagtcgatgaaagtgaagctttaactgaagagaaagaaatcaccatatcaaaatgttcaaatactaaagtgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaaca

SEQ ID NO: 118181 - DNA, 597 bp, Homo sapiens
  Payload ID: 3129
  Gene Symbol: C12orf50
  Gene Name: chromosome 12 open reading frame 50
  ENST ID: ENST00000551163
  CDS Start-End: 309-597
agtttattgacttgaaaacccctgcctactaacccgtgctatgagagtatatggatctactttaacaagggggagagagtgaagatggaagtaggagagagataaaagataaagaacaaccatggaacatgtgtcaaaagagggaagaatgttatccacctctcttcccacacaacaggggcttgtagtttttaccaaatggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatg

SEQ ID NO: 118182 - DNA, 887 bp, Homo sapiens
  Payload ID: 3130
  Gene Symbol: C12orf54
  Gene Name: chromosome 12 open reading frame 54
  Uniprot ID: Q6X4T0
  ENST ID: ENST00000314014
  CDS Start-End: 132-515
gagatggggctcaaataggaaaaagtctaggggtgaaggagtggggcaaagtgtaatttggggaaccaagcaggggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaagacttgccttcctggttcttcctgggctgtggaatgggtagtgatagaatttccaagtatgatagtgcatttggttcaaagaacagcactgtagcatgggagaacctgcactataatgtcataaactc

SEQ ID NO: 118183 - DNA, 820 bp, Homo sapiens
  Payload ID: 3130
  Gene Symbol: C12orf54
  Gene Name: chromosome 12 open reading frame 54
  ENST ID: ENST00000380491
  CDS Start-End: 37-342
tcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagagtaccactgacttgtcagtccaggcggctaaggcaagaagatgcctaacagttcccttgaggaaatgtgataatacaaacagaaaattgtatctgctagaacttgtctcagcaagaatactctatgtggttgtatgaaatgctgataatgactaagctggggagaatcccctagtgatgtagtaaactgccttattagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaacca

SEQ ID NO: 118184 - DNA, 685 bp, Homo sapiens
  Payload ID: 3130
  Gene Symbol: C12orf54
  Gene Name: chromosome 12 open reading frame 54
  Uniprot ID: Q6X4T0
  ENST ID: ENST00000548364
  CDS Start-End: 58-441
ggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaa

SEQ ID NO: 118185 - DNA, 506 bp, Homo sapiens
  Payload ID: 3130
  Gene Symbol: C12orf54
  Gene Name: chromosome 12 open reading frame 54
  ENST ID: ENST00000549398
  CDS Start-End: 1-216
ctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccaggctcatctgacacctaacccacctggagaagaagactgtctcagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaga

SEQ ID NO: 118186 - DNA, 3936 bp, Homo sapiens
  Payload ID: 3131
  Gene Symbol: C12orf56
  Gene Name: chromosome 12 open reading frame 56
  Uniprot ID: Q8IXR9
  ENST ID: ENST00000333722
  CDS Start-End: 127-1515
cgcgcctggagaggaggcgacgcgtggccggcggctttgtggcgcgcgggttccagcgcgggggcggggagagggcgagctgagggcctcgagtcccagcactccgccacgctgcgggcgccgggcatggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcaggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttattataagtgtgcaaagatctttatgccattgggcaaaagagccatttctttattagagtagttcttcaaactcactcttgccacaaaataaacgactatccatcaagacacaggaaaaaggaatgcagggatttaggaaagctgtactcacttctcttccaccttagcagcaaaagcaagaaggttctcaaaattctcctgataatagttctgttgcttaagcaataggatgccggggagtgtgggggcctgaggcatgggcattcaagttcttctcaaggtgttttatcttctcagcttgggcacagtgttctcggtgaaaccatgccaggcacaggagcatgctcttcacccgattctgtactcagagccatccaaaaaccattatttcgactaggttcttggagtccactatgtccaccaccagcagggcctggcgcatccacgccacttctggaattacagcttggtctgggcctaaggtcactcactcaagatctcatccgccagccacgcctccaggtagaacaccaaagggtctctcagttcctgcaccagaaaccaccaaggccggaggccagagttttaaaatctgctacaaagaaacctacatccattctgacatacataaagtggtgctaaacagtagcgtttctccagaaaaaaaggttctaagacaaaaatctatcaagggaacagaagcctatggagagtgaacacagaaaatataatctggtgagtttcactggtgtaataatggtgagtggtgtgaagccacgaaacatcctgagataaactgttgtggggagtataagctacagagtgattatttgggaaatgctgagcaataggatgacaccctcctcctccacctatacaaattctagtgacaaaagtattcctggaagaatgagcagaacacaggcatagctgtatagaatgtcacttcctcttttatcatagagaaagaagcttggacttcaacaaaattaagtgcatggtgccactctgtttcaggcatctgtgggctaatttgtgtagtcccatagagtctctatgaaagataaattgtctacgagcagttatggctctcccacaaccatttaaaaacttgtctttactatattttatgccataaactaatttaattccacaaatacttaactttggcatcaccgtgaggtgttgaatttggacttctaagaacataggaactggactctccattcaacttattatgacttgagggaggatcagagaaaaatctacttccaaagaaagagttcctaagccagattcgcctgtgttgggcagtggagataattactaggacattttattccaggttctgacagagccaaatgaccagctatttgacttcaagcaagtcaggccccctttccaggccacatctgtttcttcctgggcttcctctgctaggtggaagggtgggactagatgttctccaagttctcttccagctcttacattctctgcctgtgacaagacatttaacactctgaaatggagtagtgtgtttctctgctatctcggctcagtggatgattttgcactaacttcaagtaatcctcctttctttttacccaaagtttccctttcagctgtcaccagccatcaccccataaagtgtccaagtcttttccttcattacccaatgaggagtccacattttctaccctcaattttgggggcagagagagaggagcaaaatggtgtttttgagtgtcctggctgttagatgggggattattttcaagagacggtcaatcaaaggaatatgaaaagattcttggaacataggcaagtattacctcaaaccggacaaagaatgtactgatgaacccgcaggatgacaacgagaggatcaactcagctctgccttagcttctccgcagtgccctggatctgggctagtagtcatgcaggctctagtgagggcttggggtttctctcccacatgatttctgcatgcctctcccactcctctctttgccctgggatcttactttaatctctgggagcaaaatctctgtcaaaatatatctgaatctttttatgtggggctaaagtcagtggttttttggagagttaatggttgaatatttgtcaccctgattttcttcagtctactctgtataactcatgtctattcatttgcacagtctgggatcagaaactaataattcgaaggattgtccaaccacta

SEQ ID NO: 118187 - DNA, 553 bp, Homo sapiens
  Payload ID: 3131
  Gene Symbol: C12orf56
  Gene Name: chromosome 12 open reading frame 56
  ENST ID: ENST00000543259
  CDS Start-End: 1-553
aacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcagaaagctactcttttacaagatcccttctatgctagtgagttcagtcctgctattggaagtcaaaagccatataggtctgaggagaaaattaagcacttcagtca

SEQ ID NO: 118188 - DNA, 3242 bp, Homo sapiens
  Payload ID: 3131
  Gene Symbol: C12orf56
  Gene Name: chromosome 12 open reading frame 56
  Uniprot ID: Q8IXR9
  ENST ID: ENST00000543942
  CDS Start-End: 628-2496
agaaaaaaaaaatccctttctcactggttggagaaagaagacctatgtttacactccgacaatatcagaaagctgtgccaggccatgttataaccaaaagctaaatctgtgtgattgggtttaataggtttctagggttgttaaaaataaatcggtaaattaaactctttcaagtttctaacaggaaaccagattgaagctggcttccattaccaataaagtttgtattggatggtgtgatccgcaacagagtacgcagtggtggggactggcattaggggtgggcgggagagaccctaaaaatccaccgcccttcggccgcaggggacttcacggtgatgagcccgaggtgcccatcaactcgggcctgaaggaccagcgtcttgccccgcccatcgccgtctgaggttaggacaaagatcgagaggctggacagggctggggagggcgctccagggaagccgacctagcgtcgattcctgcagttgcggcccgggtccccgcgcctggagaggaggcgacgcgtggccggcggctttgtggcgcgcgggttccagcgcgggggcggggagagggcgagctgagggcctcgagtcccagcactccgccacgctgcgggcgccgggcatggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcagggaccagcaggagagcagtacaccatccaaggactcaactctctgtcctcgtccaggcctcaaaaagctgtcccttcatggccaaggtgcctttcgacccctaccttccccctccaggaggagctctcagtctgcaccaacaactggcaaggctgtcagcgagccatcttgcacaacaaacacaaaagaaccccagggacttccagatcacaactccataagtgaaattcctttcaagtgcaatgggaatggaaatgagttttacttaggaaattccctcttagattccccttcacagagcaactcaaatttagagaaaaaggagtcagaacttcatttgtatgttatttccacaacctcatcaatatttctgcacttaaaaagttcatggaacaattatattataaaagctactcttttacaagatcccttctatgctagtgagttcagtcctgctattggaagtcaaaagccatataggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttattataagtgtgcaaagatctttatgccattgggcaaaagagccatttctttattagagtagttcttcaaactcactcttgccacaaaataaacgactatccatcaagacacaggaaaaaggaatgcagggatttaggaaagctgtactcacttctcttccaccttagcagcaaaagcaagaaggttctcaaaattctcctgataatagttctgttgcttaagcaataggatgccggggagtgtgggggcctgaggcatgggcattcaagttcttctcaaggtgttttatcttctcagcttgggcacagtgttctcggtgaaaccatgccaggcacaggagcatgctcttcacccgattctgtactcagagccatccaaaaaccattatttcgactaggttcttggagtccactatgtccaccaccagcagggcctggcgcatccacgccacttctggaattacagcttggtctgggcctaaggtcactcactcaagatctcatccgccagccacgcctccaggtagaacaccaaagggtctctcagttcctg

SEQ ID NO: 118189 - DNA, 560 bp, Homo sapiens
  Payload ID: 3132
  Gene Symbol: C12orf57
  Gene Name: chromosome 12 open reading frame 57
  Uniprot ID: Q99622
  ENST ID: ENST00000229281
  CDS Start-End: 100-480
ctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 118190 - DNA, 556 bp, Homo sapiens
  Payload ID: 3132
  Gene Symbol: C12orf57
  Gene Name: chromosome 12 open reading frame 57
  Uniprot ID: Q99622
  ENST ID: ENST00000545581
  CDS Start-End: 177-556
gacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaaagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctg

SEQ ID NO: 118191 - DNA, 662 bp, Homo sapiens
  Payload ID: 3132
  Gene Symbol: C12orf57
  Gene Name: chromosome 12 open reading frame 57
  ENST ID: ENST00000537087
  CDS Start-End: 289-582
agaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 118192 - DNA, 980 bp, Homo sapiens
  Payload ID: 3132
  Gene Symbol: C12orf57
  Gene Name: chromosome 12 open reading frame 57
  ENST ID: ENST00000544681
  CDS Start-End: 306-617
agtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgggtcagacgcgggaaggcgggtcagacgcgggaaggcgggagttgggtcgggagagggcgccggatctgtgggcccatgagcggttgtcccctttctcgccacacggcggcagccacaatctgactaacattcttggcactcagagcccagggtctaccctgagcttgtgcgtccgagttgcgttttgtacagtagaggttctgtatcccttacccgaaatggttgggaccggaagtgtttcgggttttttcagatttcggaatatttacatatacatggatatcttgggggatgggacctaaatctgaacacgaaattgttttgtttcatatacacgcaccttatgcacatagcctgagggtaattttatataatagtctgaataattttgtgcatgagacaaagttttgactgcgttttgactacagtctcccccaccccc

SEQ ID NO: 118193 - DNA, 551 bp, Homo sapiens
  Payload ID: 3132
  Gene Symbol: C12orf57
  Gene Name: chromosome 12 open reading frame 57
  ENST ID: ENST00000540506
  CDS Start-End: 202-477
atggcgtccgcctcgacccaaccggcggccttgagcgctgagcaagcaaaggcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgt

SEQ ID NO: 118194 - DNA, 1684 bp, Homo sapiens
  Payload ID: 3133
  Gene Symbol: C12orf60
  Gene Name: chromosome 12 open reading frame 60
  Uniprot ID: Q5U649
  ENST ID: ENST00000330828
  CDS Start-End: 205-942
tccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgggagcctgtgttggaacttatttgttggagaaatgtcttcagagtcagaaaaggataaagagagactgattcaagctgccaaaatgttcttctttcatgtacaagatcttgcttctgtcataaacacactgactgaattgtttagccgcagtatgaatactcaaatccttttgatggctgtgaaaaacaatagttacattaaggatttttttgagcaaatgctcaaaatttttaaggagatgcaatctgtagtggatgcaagacatgacaaaattcaaaaggagtctttatgttccaaggttgcaatggccatgtgctctgtggttcagaagagtaccaatgtagaggagttgcatcagtcagctaaagaagtattcaaaagtgcccatacgccagtcatcatctctgtgctaaacagcagtaacatccttgggagtctggaatcttctctttcacacttgatgaaattccccatcatgaatcttcaattaagtgacttctatacagaagacaccaaagagcaatcagatgtcaccacatctgagagaaccagaagtcctccaggttcttccaaaaccactatgatagacaccttgaaaaaactgcaggatgtactaaaaactgaggattccaaaaatcccacaaagtcagcagcagatttgttggaacaaattgtcaaggctatgggaccaatcttagagatcctccaaaaagcgataaagactatggaaatgaatatttctgtgtttaagaaagccagtgacaagtagggatgcaacagaaatgttcatttctgtcagaaaactacttaaaatcttatggtttttcatagtagtttctaagatcttttggtgccaaacatgtgctatgttagaacataagtacacaaaagtcatctggcaaaacatttacctgtagttttgctttattaaaataaaaagaaataattaagaaagcctgtttgaaatgtcagtcactaagaagaatatattgttgaaaaaaacaaagtggtattacatttgaggatgtttctaaatattgtgtttcatcttaaagcataattaaaacaaccctaaagtagttcccactcttaactattctatttccagtgagaaatccaggtaaactgtaaatattatcattagatagaaaatctaggcctgggaaacaaaataaactccatttttgtcactcatataccaatttctatatacttcagtaccttgacgatcagaagccatcactaaatattttaaatatgattcataagtaagtgagaacagtgaatgagcaataatagacttttcttgcttatgtgagtaagaccagaacagatagttcattctcacttgtctcctgaggtcttatgattagaaaatactagaggtggaaaaatggaagtactctagcctttcacaaagaaaagactttcacaaggaaaacacttgcagaagtaggatatctgagatgtgctttatttaaagaaatgagatagggcagtctctttgtcta

SEQ ID NO: 118195 - DNA, 2073 bp, Homo sapiens
  Payload ID: 3134
  Gene Symbol: C12orf65
  Gene Name: chromosome 12 open reading frame 65
  Uniprot ID: Q9H3J6
  ENST ID: ENST00000253233
  CDS Start-End: 645-1145
cacacgccgaagggctccgagggggtcaggccaatcggcagccgtcaccccacaccccagcccatcaccacactcaaggggccgctaagacagtgtctcctaagtctcgtctcctgtccccagcggcctacagctccctgcaggctggtggccgcttacctggccgccgctcccgctgccgatgtcagggtcatgcaagcggcctctcgcgaccgttacccgagggagcgcgcgcgcgcccggcgtctctccagtgattggctgcccggaaggaggcggagacagcctcgcatggcgcgcgcgtccacctcgccgttccccctcgcgcagctccaaccaaagagagacatccaaccccgggggagtgacaagggggcgggattgctgtgaaactctcttctctgattggctctctgggagccagccgctgccacgagggaaagaagcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattagtaaagtcaatttttatggagaactgg

SEQ ID NO: 118196 - DNA, 1901 bp, Homo sapiens
  Payload ID: 3134
  Gene Symbol: C12orf65
  Gene Name: chromosome 12 open reading frame 65
  Uniprot ID: Q9H3J6
  ENST ID: ENST00000366329
  CDS Start-End: 473-973
gatttggatatccctagaacgttgagggcacgagtcgggtcctgagaccaggtaagcatctgcggagaagccaggtaaccctacggctgccgacgactgtcaaaggctccggagagaggactgcgagccgggacgcctgggtttttcccgacttgcgaccccgagtggcgcagccagtttacctgaggccgcgctggcggtggggtggggccggccgtgacacccgagctcagttttctcgggacctggtttacgctaggtgctgtgggtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattagtaaagtcaatttttatggagaactgg

SEQ ID NO: 118197 - DNA, 1326 bp, Homo sapiens
  Payload ID: 3134
  Gene Symbol: C12orf65
  Gene Name: chromosome 12 open reading frame 65
  Uniprot ID: Q9H3J6
  ENST ID: ENST00000429587
  CDS Start-End: 286-786
cttggaagatatttttggtctattgcaagaaaatatgtattagctggcagggcatgtcctggtaacatggcagacagtgcaaggctgaggagaggggcgtcttgctgaataatgtgtctctactcatttcctaaattccctcggtaacagatgggtcatcatttgaattgctttataaaaagctgtctttgaatctgaagcataatcttgagggcagatgcctcttactgaaagctctccttattcatctaacccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctata

SEQ ID NO: 118198 - DNA, 573 bp, Homo sapiens
  Payload ID: 3134
  Gene Symbol: C12orf65
  Gene Name: chromosome 12 open reading frame 65
  ENST ID: ENST00000546132
  CDS Start-End: 284-573
gcgaatcctccgctgaggtgatttggatatccctagaacgttgagggcacgagtcgggtcctgagaccaggtgctgtgggtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaaggtagatca

SEQ ID NO: 118199 - DNA, 604 bp, Homo sapiens
  Payload ID: 3134
  Gene Symbol: C12orf65
  Gene Name: chromosome 12 open reading frame 65
  ENST ID: ENST00000536130
  CDS Start-End: 496-604
gattgcgaatcctccgctgaggtgatttggatatccctagaacgttgagggcacgagtcgggtcctgagaccaggtaagcatctgcggagaagccaggtaaccctacggctgccgacgactgtcaaaggctccggagagaggactgcgagccgggacgcctgggtttttcccgacttgcgaccccgagtggcgcagccagtttacctgaggccgcgctggcggtggggtggggccggccgtgacacccgagctcagttttctcgggacctggtttacgctaggtgctgtgggtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttatgagcaccgtgggtttatttcattttcctacaccactgacccgaatatgcccggcgccatggggactccggctttgggagaagctgacgttgttatccccaggaatag

SEQ ID NO: 118200 - DNA, 3733 bp, Homo sapiens
  Payload ID: 3134
  Gene Symbol: C12orf65
  Gene Name: chromosome 12 open reading frame 65
  ENST ID: ENST00000543139
  CDS Start-End: 3319-3733
gctgaacataggaccccaatcccttctagcttgtagtgtttctcctgagaaatctgctgttaatctgataggttttcctttataggttacctggtgcttctgtctcacagactcttaaaattctttctttcattttaactttgtccggaattggtgggttcttggtcttgctgacttcaagaatgaagccacggaccctcatggtgagtattacagctcttaaagatggtgtgtccagagtttgttccttcagatgttcagatgcatccagagtttcttccttctggtgggtttgtggtctcgctgacttcaggagtgaacctgcagaccttcgcagtgagtgttgcagctcttaaaggcagcacagacccaaggagtgagcagcagtaacatttaccacaaagaccaaaagaacaaagcttccacagtgtggaaggtgacccgaacgggttgcactgctggctcaggcagcctgcgtttattcccttatctgaccccacccacatcctgctgattggtccattttacagagagctgattggcccattttacagacagctgattggtctgttttgacagggtgctgattggtgcgtttataaaccttgagctagacacagagtgctgactggtgcatttacaatcctttagctagacacaaaagttctccaagtccctagatttagctagacacagcactgattgatgtgtttacaaaccttcagctagacacagagtgctgattggtgcatttacaatcctttagctagacacaaaagttctccaagtccccactagattagctagacatagagcactgattggtgcatttacaaaccttgagctagacacagggtgctgattggtgtatttacaaaccttgagctagacacaaagtgctgactggtgtatttataaacctttagctagacataaaagttctccaagtccccacccgactcaggagtccagctagctttgcctactggatcccatgctggggccgtgggtggagctgcctgctagtcccacaccatgcccccgcactcctcagcccttgggcggtcaatgggactggttgcagagcagggggcggcgcccgtccgggaggctctggccatgagggagcagggcagggggagggggggactcaggcatggcgggttgcaagtcccacgccctgctccacggggaggcagctgaggcccagcgagaattcaagcacagcccgggtgagctggcagtgctgggggacccggcacaccctccacagctgctggccggggtgctaagcccctcactgcctggggccggcggcaccagccggccactcctaggtcggggcccgccaagccctcactggcccgcgagctctccctccacacctccccacaagcggagggagcccgctttggccttggccagtccagagaggggcttccacagtgcagcggcgggctgaagggctcctcaagcacagccagagtggatgccgaggccaaggaggcgccgagagcgagtgagggctactagcacattgtcacctctcatttggataacctgatgacaatatgcctagatgaagatctttttgcaatggatttctcaggtgttctttgtgcttctcgtatttggatgtctaggtctctagcaaggccggggaagttttcctcgattattcccccaaatatgttttccaagcttttagatttctcttcttcctcaggaacaccaattattcttaggtttggtcgtttaacacaatcccagacttcttggaggctttgttcatattttcttattcttttttgtctttgttggattgggttaatttgaagaccttgtcttcgagctctgaatttctttattctacttgttgaattctattgctgagactttccagagcattttgcatttctaaaaatgtgtccaaagtttcctgaattttttattgttttttctttaagctatctatttccctgagtgatttctcccttcacttcttgtatcattttttggatttccttacattgggcttcacctttctctggtccttccctgattaataactaacctcctgaattctttttcaggtaaatcaggtatttcttcttggtttggatccattgccagtgaactagtatgttttttggggggtgttgaagcgtcttgttttgtcatattaccagggtttgttcatttgggtaggctctgtcagagggaaggtctagggctgaaggctgttcagattcttttgtcccatggggtgttctcttcatgtagtactctgccccttttcctatggatgtggcttcctatgagccaaacttgcagtgattgttgtctctcttctgggtctagccacccagcgaatcttcccagttccaggctggtactggaggttatctgcagagtcctgtgatgtgaaccatctatgggtctctcagccatggctaccagtgcctgttcggtggaggtggcagagggtacaatggagctttggtgggttaatggtctattttttttgctggttggcctcctgccaggaggtggtcctttccagaaagcatcagctgtggtaatatggggaggaaccagcagtgggcggggccctagaactcccaagatttatttgccctttgtcttcctgccagggtgcatagggaaggaccatcaggtgggggtggagctaggcgtgtctgagctcagactctccttgggcgggtcttgctgcggctgctgtagggaatgtgggtgagattcccaggtcactggagtcgtgtacctaggagagttatggctgcctctgctgagtcatgcaggttgtcagggaagtgggggaaagctggcagtcacaggcctcacccagctcccacacaaacccaagggccggtcttactcccaccgtgttcccccacaactgccccgagtctgtttccaggcagagggtgagactggcttgaaaatttgccccaaggctgtgcccctcccagcagcgaaagaaaagggctgtagttcttcccccacctgtgaagtctgcatgctggattcgtgcagttgcccaagttctggccaggaggcttctcaccctgtttaaattgttacgaagttcgactagagaattcttctccctgtggagttttatcccttgctcctctggccaccctcccgatggatccctgtggtgccaggcaggaatgggccttctggggacccagcgagctcccacggcctttctgctgcttcctctacccctgtagttcgctctgctgagtctgacttagctccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaac

SEQ ID NO: 118201 - DNA, 2698 bp, Homo sapiens
  Payload ID: 3135
  Gene Symbol: C12orf66
  Gene Name: chromosome 12 open reading frame 66
  ENST ID: ENST00000311915
  CDS Start-End: 29-1435
acgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggagccaaaggttcctgttaccaatgcaattatttcgtggccttttgcctgaattattctaagctgcttctccagaggaaatgagtcagaagaaataggcttgatgtgcatttctgcctttggagacttctcttgatatggtgtaaatccgtaaggtttcattaatgccttgtctgcatattttttcaatctgcttttgataacaaggtctgtttctagggtacttcaaatttaaaaccgtagggtatgtgtaaaatatcaccactagaaaatggagagatgcaaatgggttcccccttctgtagtccctcctaatgtcagaatctggggttagggttctaagtgatggtagcactcaggagagggtcacaagaggcaatgacatgggactgcatcctgaaagatgactgcttagacgtgcggcgagaatggccggaaaacggaggatggcgcttgacattgatctaggaaaggaagacagtcattgggacttttgctaactttgtccctagagagtgaattctgcttttgctggtcctaaaaactgtagagtaattctacaatccagttaaatttgtaaatctaatgcctgattcagtctgagatttatgactcagccggttgatccagcttaggtctagactcatttcacttttgttatgacaagatacgacaatgtagggcacaccctttaccccccagggtcatcctgatgtcagtcatttcaggctaggccagtgtcagagcagtccctgaagcagaagtggatggaaagaggtgaatgatttctaatattcaacattcattaatttaacatcaactatgttaagggtaatgatatagcagttaaccaagaccaacatggtgtctgcttggttgatgcttgaaataaggtgacctggccccagccacccgggtggccaggagctgaaagggctgtaacaagtaggcagtgaatagtcttcaaacttgttacttgcatacctccctacaaattttggaaaaaccatgagactctgattgattttttaaaagaatatctaaaatcattatgtttaaatagcctcaaaagaagcattttattatgtattgtaaatattggcattttaaaatgttattcggtcttttaaatgtatccagtgaaatgttggtacaatagagttttgatagctaccattttccatttttaaaaatactttaacacgctttgtaacagttggaaatattgtttgattccttttgctccctgaactccattcttcttcttctgaagaattttatcctaaaatgaatttattttttgcttaacagtcttattggttaccttattaaatattactcagtata

SEQ ID NO: 118202 - DNA, 4151 bp, Homo sapiens
  Payload ID: 3135
  Gene Symbol: C12orf66
  Gene Name: chromosome 12 open reading frame 66
  Uniprot ID: Q96MD2
  ENST ID: ENST00000398055
  CDS Start-End: 55-1392
ccggaagtgcgaggccgaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggagccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagttgttactggtttgatggttcctttgaagcttgtgtgaaatgtaatggtcatattcgtcttttttcccatgattgtgtggagccactgttttactgggtgtccacagcaggtatgccagcaacatcagcagagaccagagagcccctcagagtccatgtaggaagcctgcccacctagggtggactgcctggcagaagaaagaagaaccggccaggcacggtggcacacgcctgtaatcccagtactttgggaggctgagacgcgtggatcacttgaggtcaggagttcgagatcagcgtggccaacatggtgaaaccccatctctactaaaaatacaaaagttggccggttgtagtgacgggtgactgtaatcccagttactctggaggctgaggcaggagaattgcttgaacctgggaggtggaggatgcagtgagctgagactgtgcagctgcactccagcctgggtgaaagagcgagacctgtctcaaaaaaaaaaaaagaagaagaagaaccaagaatctactggcctattttttattttctgggaagaacatgtgtttttcctttttttttttttttttttttgagacagggtcttgtctgttttccaggctggagtacagtggcacaatcacaactcactgcagcctcaacctcctgggctcaagtgatcctcccacatcagcatcccgagtaggtgggattacaggcatgagccatcacacctgggtctcactatgttgctcgggctggactcaaactcctggactcacatgagcctcccgcctcggcctcccaaagcactgggtttataagcatgtgccactgcacctggcctcctttctttttctttaaaaatggtcataagctttgtaaaaagctagtttgctttaaatagaaagtagtgatttacctctgcattttattcactcaggttctataaaaaaagtctcagcagattttacaacattgaccttacctaagaaattgaaagcaattggagctaaaaagtcaaatcacttttcctctctattgtgttctgccaagaaactgaaaaatattccttggtatgcatgtatttttttcctcttagattaaaccaccattagccttaatgacacagtcccccaaatacctagaagaatatatacttcagtggaaccccgagagaggtgtaagtaaagcatatatatgttatttaaataaccagtcctcacctagaacatatttgaattgtatatctatttttaaacataaacacaaaaagaatttcaaagaacagaaggcagatgtgaatattaagaaaatctaagacaatatgtattactgtgcagctgtcatagactgtactggaagagtttttgaagattgaatattgatacttaaattatttctgaagctcttcaataaagttttctaattataaaaactccacataatttggttcaagccaagaaacaaagtcattttactctaagatttattctctaaatatagtaatgagatctgtaaagtctgtgttttgctaattaaaagagtaaatctgc

SEQ ID NO: 118203 - DNA, 2441 bp, Homo sapiens
  Payload ID: 3135
  Gene Symbol: C12orf66
  Gene Name: chromosome 12 open reading frame 66
  ENST ID: ENST00000544871
  CDS Start-End: 60-1238
agaacccggaagtgcgaggccgaggagagccacgtgggtcgagctggggcgcagctcgcatgggggagtctatcccgctggccgccccggtcccggtggaacaggcggtgctggagacgttcttctctcacctggggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggagccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaa

SEQ ID NO: 118204 - DNA, 957 bp, Homo sapiens
  Payload ID: 3136
  Gene Symbol: C12orf71
  Gene Name: chromosome 12 open reading frame 71
  Uniprot ID: A8MTZ7
  ENST ID: ENST00000429849
  CDS Start-End: 32-841
aagttgagagaaatttgtgcctttgaactccatggcatattcatcctctaacagcgacatagaggacgacagctccaaatccaattccaacctgagcctctctgtgggctatttcccctgtgaggacaccccctgtgaggacacaacctcctgggaagatgcaccttccaagggtccttccatccactttctgcctcccgtccaaggggcatgggggactgaaaggatagggagacgcatgaagagacaagaccaaattcaggatgaaccagagcagttttgcaaactaagcatcttcctggcctgggacgtggacattggctccgataacacagactcaagagctaataggcttctaaatggagacaacctgtggatagacaagttaccaaaagagagaacaaaactgtctgttggcaaactgaataatcttgtgcaagagtttcagatatttctagaaaatctgaaagatgatgacgctgtatttcctgaaactgctcagcaagatttccagctatccagcggctcccctccggaaatggttcagatgataagccaggcaaccgccagccaaaggacaagcgctccagagatctcctcaatcctgtcagagcagccagagaaggatgacactccttcacacacacaggcccagtgctgcctgaactttgggtgggccttcagctggctgaggcagcgtatcctcccctctctgctgaggagggatcaccctgtgaatgccaccaaaagtccccatcggtcagcaccaacgaaaagactctttcacagaggcaagagaattcaacctcaagaaacccttgaattaggacatcccatatagacagatttttaaactttttggaaagtttaaaataatccataataaggattccattaataatccccatcagtttgttttttcctcaataaacaaaataaatgctcttgttaccccac

SEQ ID NO: 118205 - DNA, 1738 bp, Homo sapiens
  Payload ID: 3137
  Gene Symbol: C12orf73
  Gene Name: chromosome 12 open reading frame 73
  Uniprot ID: Q69YU5
  ENST ID: ENST00000378090
  CDS Start-End: 207-422
tgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggtaaaaatgccatctttatttcattaagtactggttctaagtgacttccaataagatacattttcttcctgttttgaagttgatccccattgtgaaaaatatacattgtagtggtcatggaaatgcgccatccatactccctaaggcaggcttgttgccctagtatcaagcatgccagcagctttcaatggtcagcttctagaaggattgcctcggctatggtggccttgctcaaagccatgcctcctgaaggggcccaaatccagtgactgttggaggtgagaatagaaaggcctggccacttcagcacgtgagtggtgggcaactctgctgggcccaccacaactccctatggggtttagggacactgtctttggatctgcattgcaactcaacttatacctctgctcagtcctgtttcctttctcaggtgttgatcgaagggtgtgccttcatagaccccctgctaaactgcacctcagtgtttcttggagaaccaaatctgtaacatatatgcattaaaaattaaaggcagtacta

SEQ ID NO: 118206 - DNA, 660 bp, Homo sapiens
  Payload ID: 3137
  Gene Symbol: C12orf73
  Gene Name: chromosome 12 open reading frame 73
  Uniprot ID: Q69YU5
  ENST ID: ENST00000553183
  CDS Start-End: 204-419
cagaagacggggactaggagcgctctgccgacgtcagcttttgtctccagtattttcgggggctggtggacgcgtgggcgatagggtgctgtccttggggtgctgtgtatatgggatgatgacgcttatcagcattatctagtcctttccaccccgaaattcgccccgattaaagactgtgttgcattatcagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaata

SEQ ID NO: 118207 - DNA, 582 bp, Homo sapiens
  Payload ID: 3137
  Gene Symbol: C12orf73
  Gene Name: chromosome 12 open reading frame 73
  ENST ID: ENST00000546819
  CDS Start-End: 158-319
gtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgatgagaaacaggttgagaagagtgaagttgatttctcaaagtcacatagcttagtgagacgatttgaggatctgaagcccaagctttctgtttggtatgtctcttttttgctcctgttcataaaataatccaatactcttgtaaaacattcaaattgagttcaagtatgtagagtaaaaagtgaaaatcccccctcttataacctcctttctcctgtctgctcacgacacgttaactactgtttcttgtttggtgaatatcctttactacttctcactgttgttgaatgtccactgatacgggttggatatttgtct

SEQ ID NO: 118208 - DNA, 1243 bp, Homo sapiens
  Payload ID: 3137
  Gene Symbol: C12orf73
  Gene Name: chromosome 12 open reading frame 73
  ENST ID: ENST00000547975
  CDS Start-End: 124-303
gtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggtaaaaa

SEQ ID NO: 118209 - DNA, 590 bp, Homo sapiens
  Payload ID: 3137
  Gene Symbol: C12orf73
  Gene Name: chromosome 12 open reading frame 73
  ENST ID: ENST00000546540
  CDS Start-End: 156-296
attttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctggtgagtgcgggagggctactattttatttttgagctaaatatacctcatttctttgtaaattacccagccttaggcattcctttatagcaatgcagatgctcctggaccactccattctcctcgtggcagcaaaagtgatcttgaacgaaattaggatcacatttgccctgggcccaaaacctttggatggcatcccattgcatctagggcaatgcatggcctgtgaggtcttacacagtctggccgctgcctacctgtggcctatctgccaccattttaccagttctttcccctgttaacattcacgcctgcttccttgctgtttc

SEQ ID NO: 118210 - DNA, 1446 bp, Homo sapiens
  Payload ID: 3137
  Gene Symbol: C12orf73
  Gene Name: chromosome 12 open reading frame 73
  Uniprot ID: Q69YU5
  ENST ID: ENST00000549478
  CDS Start-End: 453-668
gtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggt

SEQ ID NO: 118211 - DNA, 685 bp, Homo sapiens
  Payload ID: 3137
  Gene Symbol: C12orf73
  Gene Name: chromosome 12 open reading frame 73
  ENST ID: ENST00000552940
  CDS Start-End: 410-589
agttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagct

SEQ ID NO: 118212 - DNA, 463 bp, Homo sapiens
  Payload ID: 3137
  Gene Symbol: C12orf73
  Gene Name: chromosome 12 open reading frame 73
  Uniprot ID: Q69YU5
  ENST ID: ENST00000547945
  CDS Start-End: 145-360
tcacgtgcctgcgccggcagcgctcccactttcctgtccggtgcggccccgggtccctgtattttgggtccggcctgctcgccgtccgctccgtccgcccttagacctgttgcccagcatccctgcagttcgcgcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgca

SEQ ID NO: 118213 - DNA, 620 bp, Homo sapiens
  Payload ID: 3137
  Gene Symbol: C12orf73
  Gene Name: chromosome 12 open reading frame 73
  ENST ID: ENST00000549960
  CDS Start-End: 77-238
gtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgatgagaaacaggttgagaagagtgaagttgatttctcaaagtcacatagcttagtgagacgatttgaggatctgaagcccaagctttctgtttgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtg

SEQ ID NO: 118214 - DNA, 540 bp, Homo sapiens
  Payload ID: 3137
  Gene Symbol: C12orf73
  Gene Name: chromosome 12 open reading frame 73
  ENST ID: ENST00000552460
  CDS Start-End: 1-114
atgcccgcgggcgtgcccatgtccacctacctgaaaatgttcgcagccagtctcctggccatgtgcgcaggggcagaagtggtgcacaggtactaccgaccggacctggtgtgaatagtggtttggagcacaatgttgggagcagtcatttctgtttggactctgcctggacagatgagaaacaggttgagaagagtgaagttgatttctcaaagtcacatagcttagtgagacgatttgaggatctgaagcccaagctttctgtttgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgta

SEQ ID NO: 118215 - DNA, 1856 bp, Homo sapiens
  Payload ID: 3138
  Gene Symbol: C12orf74
  Gene Name: chromosome 12 open reading frame 74
  Uniprot ID: Q32Q52
  ENST ID: ENST00000397833
  CDS Start-End: 452-1024
agccgttgtttacctgacttgttcttaggctgccttagattctgagctggcttccctttaggctttttcataaacaaataactggaaatgtctctaaggaggggagagaccagttcctcattgcagctggtagcaaggttgctttcactcagccaggaggacgcattgttacaggtgtggaacttgttgctccgagccctcgcctggcagctcactctggatctgcgggttctgaggagcctcgggacccacctgggtgcagttgccttcagggacagaccatcttacagatgcaataacctgcttgacattctcctctggaaaaggaaaagaactacgagaggaagcatggcacttggatgcagaaattgagcaccctccatgtgatccagagaacagcaactcatacgtcttctggaaccttctaccaacagtagaacctcttagctttatggagaaaacagagtcattctgtccagaggtgccaccccaagactgtggagcctctcctcggccctcgctgaggagcctgccaaagaaccaggggagtctcctccagtttgaccggcaagccccaggccgcatctccacctcgcccactttgaggagattaaggacccgtggctgtgggacaaggcaggatgcctggcaggtgaccacctggggaagctggggagctcctgtgggcttcccatgttacctttcgaagagcctgccaggaagcccaaaggattcttcacacttgctgtcacccttgagactccactcaagattgacctctgaacctgaaagggccctgaatgcagctgactcactggagccccaaacccggcccactgacaagtatctccctcctgagcttcagcctgtcaatgaagggtcccttcaccaggcctctcttcggcagcaagaaggccacttcctgcccagccccaccctacgacaccctagtcctcagggagaagaattgcacccatccaggtgtgtatgcatttattttctccggtgctatgacatctgttgactatttactattagatttttatttctgtcctgacataacaaagctgacggtgtgttaaccagtgcactttgttttatagcactcaagtcactcttcgcatttataggtgcacgagttttcatttcaagagtctccctttaagagcacagcatttgggggcaggatacaatgccatatgcagtcatagttttcattttgaattgtcaatgtcttggccctgtggcttaattaacatccacttagtaataggttttgtctggtagagaaaatagaaaggccagagatatgcaacagcttttcaaagaaaaatttggaggataaaagaaaggaacaagatgtcctggttaaatctagggtgacctttaaaataacctgttatgacagactgtgcccttatccagaatgaagtagactgtgtcatttccaaaaccagctctgaactttcagcacggccccctggttgtagcaatggatctgccatctctgacagggatgaagagtttctgcagcagcaagggaaagatccatgcccaattttatcttcctgacttgtgggattggcaggaaagccctcatttcatttgaaaagtcacagaggatttttttggagaaatagctgctgttttattactggacctcaatcctcaagcaatagtttgatattcatagcagtaaggataacatccatgtacacattctttgttgattttaatccttgttggcctaattgtaccaacaaaggtagaagatacttaccaagccatagggaaatgcaaattgttatgtctgtgtatcagctagctgttgctagataaaaaaccacttaaagtaa

SEQ ID NO: 118216 - DNA, 2184 bp, Homo sapiens
  Payload ID: 3138
  Gene Symbol: C12orf74
  Gene Name: chromosome 12 open reading frame 74
  Uniprot ID: Q32Q52
  ENST ID: ENST00000544406
  CDS Start-End: 267-788
gttgctccgagccctcgcctggcagctcactctggatctgcgggttctgaggagcctcgggacccacctgggtgcagttgccttcagggacagaccatcttacagatgcaataacctgcttgacattctcctctggaaaaggaaaagaactacgagaggaagcatggcacttggatgcagaaattgagcaccctccatgtgatccagagaacagcaactcatacgtcttctggaaccttctaccaacagtagaacctcttagctttatggagaaaacagagtcattctgtccagaggtgccaccccaagactgtggagcctctcctcggccctcgctgaggagcctgccaaagaaccaggggagtctcctccagtttgaccggcaagccccaggccgcatctccacctcgcccactttgaggagattaaggacccgtggctgtgggacaaggcaggatgcctggcaggtgaccacctggggaagctggggagctcctgtgggcttcccatgttacctttcgaagagcctgccaggaagcccaaaggattcttcacacttgctgtcacccttgagactccactcaagattgacctctgaacctgaaagggccctgaatgcagctgactcactggagccccaaacccggcccactgacaagtatctccctcctgagcttcagcctgtcaatgaagggtcccttcaccaggcctctcttcggcagcaagaaggccacttcctgcccagccccaccctacgacaccctagtcctcaggtaacacagctctaagcctccggcctctcagttgctgaaccacaaagcaaaatagatctcagagttgcttagttcccccaagggccagtagatcctaaaaaggagacagcacaggaagtcacactgaggggacacattctctttaggaagcattggctcttaagtgaaaggagggcagcaatctggggaggaaagaaaatgatctcgctcactttcttctgtccttagaggcactttgagaaaggatgcaccaaggccaggcttaccgatggtctgtcaggtacccgagagcaatgggggccctcttgcaaatgcacactatttaaagacaacgtcgtgtcactgatttaaaaggggagaaagagccagttattcaaatttccaatcccaccaaaatgtaaaacatgttttaactaggagggctcattgtttctcctttcaacatgtttgctttggagtttgggatgggtttgagcaagactaaaacatatgttcttaaaatttatttcagggagaagaattgcacccatccaggtgtgtatgcatttattttctccggtgctatgacatctgttgactatttactattagatttttatttctgtcctgacataacaaagctgacggtgtgttaaccagtgcactttgttttatagcactcaagtcactcttcgcatttataggtgcacgagttttcatttcaagagtctccctttaagagcacagcatttgggggcaggatacaatgccatatgcagtcatagttttcattttgaattgtcaatgtcttggccctgtggcttaattaacatccacttagtaataggttttgtctggtagagaaaatagaaaggccagagatatgcaacagcttttcaaagaaaaatttggaggataaaagaaaggaacaagatgtcctggttaaatctagggtgacctttaaaataacctgttatgacagactgtgcccttatccagaatgaagtagactgtgtcatttccaaaaccagctctgaactttcagcacggccccctggttgtagcaatggatctgccatctctgacagggatgaagagtttctgcagcagcaagggaaagatccatgcccaattttatcttcctgacttgtgggattggcaggaaagccctcatttcatttgaaaagtcacagaggatttttttggagaaatagctgctgttttattactggacctcaatcctcaagcaatagtttgatattcatagcagtaaggataacatccatgtacacattctttgttgattttaatccttgttggcctaattgtaccaacaaaggtagaagatacttaccaagccatagggaaatgcaaattgttatgtctgtgtatcagctagctgttgctagataaaaaaccacttaaagtaaca

SEQ ID NO: 118217 - DNA, 689 bp, Homo sapiens
  Payload ID: 3139
  Gene Symbol: C12orf75
  Gene Name: chromosome 12 open reading frame 75
  ENST ID: ENST00000552457
  CDS Start-End: 219-359
ggcgaggggtgccgggtggtttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttc

SEQ ID NO: 118218 - DNA, 1366 bp, Homo sapiens
  Payload ID: 3139
  Gene Symbol: C12orf75
  Gene Name: chromosome 12 open reading frame 75
  Uniprot ID: Q8TAD7
  ENST ID: ENST00000443585
  CDS Start-End: 257-448
gggtgggtccggcgggtccccgggcggggcggggccggggcgaggggtgccgggtggtttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 118219 - DNA, 719 bp, Homo sapiens
  Payload ID: 3139
  Gene Symbol: C12orf75
  Gene Name: chromosome 12 open reading frame 75
  ENST ID: ENST00000549893
  CDS Start-End: 183-329
gcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtgccattctcaagcacaacctgggtgaggctctgtcattgcttaatggatcagctgtatagtaacagcagaagataaaacatggtgagttgtgacaatgtaatgtcacagacaattttcctatttaaggttgttgttacagttctgactttggcaagcagaatggtttcaatagagcaatgtggggcttactatattaccatgcctacaggagcagttaaagcttcatgaaagtaattgaaagactaaattttgggctcaacatttaaaacaaaatcaattagatggtttagaagtattttatgaatatccaacagagacagaaatggaggtttctaataattaaaagtgttgctggatgtgtcaagatatacttgaaaagtgttttttaaaatttaaattggctgccaaccttgttcatcaaattcccctaaggcaacacaataatttaggaatggaagcaattgt

SEQ ID NO: 118220 - DNA, 291 bp, Homo sapiens
  Payload ID: 3139
  Gene Symbol: C12orf75
  Gene Name: chromosome 12 open reading frame 75
  ENST ID: ENST00000549934
  CDS Start-End: 25-291
gcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaaagaaaataacatcatgactcaagaatcaagagcttgctcatcagtttggaaggaatttggctccgtgggacgttgtaat

SEQ ID NO: 118221 - DNA, 1329 bp, Homo sapiens
  Payload ID: 3139
  Gene Symbol: C12orf75
  Gene Name: chromosome 12 open reading frame 75
  ENST ID: ENST00000612117
  CDS Start-End: 257-412
gggtgggtccggcgggtccccgggcggggcggggccggggcgaggggtgccgggtggtttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttc

SEQ ID NO: 118222 - DNA, 1964 bp, Homo sapiens
  Payload ID: 3140
  Gene Symbol: C12orf76
  Gene Name: chromosome 12 open reading frame 76
  Uniprot ID: Q8N812
  ENST ID: ENST00000309050
  CDS Start-End: 366-773
agggagaagatgactgagccggccgggtgcagtggctcacccctgtaatcccaatactttgagaggccgaggtgggtggatcacctgaggtctggagttcgagaagatgacggagcagtgtgagccctactgaaccacatccagtggattttccttaggaaggaagatcctgttaccagacaaaatgggaaaaggaagtgaggagggtgatgtgagagcttgagggggaggtcagaaggtcagagatgacccagttctggaggtgaccccatagaaggagaagaatccagccacgtgatacacgggaccaagagaacagtaaatgcaaagatctggaagcacaaaagaggaacagcaaggacagcatgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactcca

SEQ ID NO: 118223 - DNA, 496 bp, Homo sapiens
  Payload ID: 3140
  Gene Symbol: C12orf76
  Gene Name: chromosome 12 open reading frame 76
  ENST ID: ENST00000551185
  CDS Start-End: 71-301
agacctgggaggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctact

SEQ ID NO: 118224 - DNA, 1755 bp, Homo sapiens
  Payload ID: 3140
  Gene Symbol: C12orf76
  Gene Name: chromosome 12 open reading frame 76
  ENST ID: ENST00000546651
  CDS Start-End: 61-210
ggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggatcaaactcttcattgaagtactcatcaggcgtgatggctgtggggttgtttgcagtagcacattccgtggtgaggtcctgctgagccagaactcaggagagtcagaaatgccaaatgatgttcacaagtgaaggcctgtggcactcagtgtctgaggtggacgtgttaaccagctaaagaccgggaagttctattcactaacttttttgcatggaacaagaaaatctatgaggatatcaccaaactacacaggaagtgtaatggatttcttcattttaaaatatttctctactctcctttacatttttatctcctgattataacaaagaaaaaaagaaagaaatatctgaaagtgcatgagacttggaagacttggagttgaagttctagctgtttccctgtctagctttgatagtggaaaggtaatttcatttttctgacccgcagggacatccactgtaccaagttcatatagttactgtgagcatcaagtaagaaaatatttgttaaggtgctctgttgcaatataaagtcctgaatcctttttaagttccatttctataaagaggcccctcgtttataatggataagagggaaagcacctgatttctataatcactacccctcctctaaaatccttatttattttcaaagagtcactcatctaattctcttccaaaagagtatctcaaattccagcttgggggtatctttggcctttacatagagtgggctgttcaggatccagtaaatgccatcccagacacagacaagttgtttcctttcatctaactgcaatgaaagctcattgcttcaacttaccccttgtgcaccaaattggtgttccacagttcccagcaaagattccagcgggttcctgtctgctacagaggggtagggagtttaaagtctaatattatatctcacttgtggctataaaaaaaagatcttcattaaagtttctggtccaagctacctcattaggaaatgcaattacagactggctgatcaaatcattcacaataaccataaactaatttatcctttatagggtgcttttcatgaggatctctaaactagataaacagttgtaagaattaaagcagaataatgggaagagtctggattttggagtgagccagacctggattccaaccccaccttggccactcgctacccatgtgttctgggcctcagttccctcatctgtcaaagtggagtaatggcaatggtggtggtggtgctggtgaacaattactgcatgcttaccacatactgcaggcgccattctaaaggcttccacgtcgtaactcatctaatcctctcaataactctaaggaaggttgggtatcacctgcatttcactgctgaggaactaaggcacagagcagaagtaatttcacaaggccatagaactggtggggctgggatggggctgggatgtggcaaccacatgcaatgtttttgcttggaccccaagttctgtctaaatctttcatcacaatagtttggactaaatcactcattccaatgataaatattctcaaatgtccttatctcc

SEQ ID NO: 118225 - DNA, 461 bp, Homo sapiens
  Payload ID: 3140
  Gene Symbol: C12orf76
  Gene Name: chromosome 12 open reading frame 76
  ENST ID: ENST00000546627
  CDS Start-End: 28-213
ctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagacaactggagagaggatctgtttacagctgtttgcacagcacttgacatagtgcctggcagcaagtggcatttgataaatcattggcagtgagtggatgaattgcctaacctggagctgccattaggaagtaacctgttttccctttgcagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggcca

SEQ ID NO: 118226 - DNA, 607 bp, Homo sapiens
  Payload ID: 3140
  Gene Symbol: C12orf76
  Gene Name: chromosome 12 open reading frame 76
  ENST ID: ENST00000547573
  CDS Start-End: 58-288
gacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacaggtgcccgccaccatgtccggctaatttttgtatttttagtagagatggggtttcaccatgttggccaggctggtctcaaactcctgacctcgtgatctgcctgccttggcctcccaaagtgctgggattataggcatgagcccccttgcctggctaaatcttggtttttcaaaggaacagtaatgagactgaagaacaaccatggttaggccctagctggaacctgggatgggcccacatccctacagacacacatcagtgtacatttgcttgttttgaatgcttcccaagatcgctgagata

SEQ ID NO: 118227 - DNA, 2204 bp, Homo sapiens
  Payload ID: 3140
  Gene Symbol: C12orf76
  Gene Name: chromosome 12 open reading frame 76
  ENST ID: ENST00000548191
  CDS Start-End: 259-582
gtcattggaagagctcaaagttaaaggctcccgctaaaaatcagtatgtttcattttgcagttactgggagggggcttgctgtggccccatctgggagagttgagccctggtccagccccgcgcaggaagggaggctgtaaccgtgccagcctgctgcagctgcagtgatgttttcctgtatgagacaaacaaagtcgcccggatccaaagcatcaattatggcaccattaagttcttccacgtgatcgtcttttcctatgttagagagggaaaacgagtcacacggaagcaagtcatgcagccgagctaggattggaacggaagtggcctgcagagcctgcctcccaccccactgtgctatgcctcccattgatgctttcctgtgcctgccatttagctttgctctggtgagtggcaagctgtaccagtggaaagagcctgtcatcagttctgtgcacagcaaggtgaaaaggacagcagaagtgaaagaggagatcgtggagaaagaaatgaagaagttggtgcacagtgtctttaacatggcagattacaccttccctttgcaggtgaacacctggtagtgttaacggaccccaacacttacccaaaggtagccattgggtcaggtttctgcactatagtcccttctgtggttgccagaaatacgttacaggaaaagggtcccgatccagaccccaagagggggttcttggatctagcgcaagaaagaattagggcaagtccacagtgcaaagtgaaagcaagtttattaataaagtagtggaataaaagaatggctactccatagacagagtagcccccgagggctgctggttaggcatttttatgattatttcttgatgatacgctaaacgaggggtggattattcatgcctcccccttttagaccatatagggtaacttcctgacattaccatggcatttgtaaactgtcatggcgctgctgggagtgtagcagtgaggacgaccagaggtcactcttgtcaccattttggttttggtggtttatagcaggctcctttactgcaacctgttttatcagcaaggtctttatgacctgtattttgtgctgacctcctatatcatcctgtgacttagaatgccttaaccgtctgggaattcagcccagtaggtttcagcctcattttacccagctcctatttaagatggagttgctctggttcacacgcctctgacatttgtattgcacatccattgtgaggtgaatgatactaatcccactacaaatcaaaccttcaggaggtgaggcaatgtgtgaggtggtaaagcctccagattcaaaactatgcttgggtcaaattctagctctgccactttgtgtgtgcagtgttgggccaaacacttagctcaattccctcatgtattcagcaaacagttactgaatataatatgctactcttctagtcttgtagcaggacgagccgcagacaaaacctctcagacaccgagttgtagaaggaagggctttattcagctggcagcatcggcaagctactgccttaaaatccgagctccccgaatgcacaatttctgtcccttttaagggctcctcacagcactaaagatttcacatgaaagggtcgtgattgatttgagcaagtaggtggtacgtgacaggggctgcatgcaccagtggtaagagagaaacagaacagggcagggagtttcacaacgttcttctatacaatgtctggaatctatgaataacatcggtttctaagttatgagttgatttttagctactgggtgtgaggcctctgagcccaagccaagccatcgcatcccctgtgacttgcacgtatacatccagatggcctgaagtaactgaagatccacaaaagaagtaaaaatagccttaactgatgacattccaccattgtgatttgtttctgccccaccctaactgatcaatgtactttgtaatctcccccacccttaaggtactttgtaatctcccccaaccttaagaaggttctttgtaattctccctacccttgagaatgtacttcgtgagatccacccctgcccgcaaaacattgctcttaacttcaccgcctatcccaaaacctgtaagaactaatgataatccaccaccctttgcttactctcttttcggactcagcccgcctgcacccaggtgaaataaacagccatgttgctc

SEQ ID NO: 118228 - DNA, 1302 bp, Homo sapiens
  Payload ID: 3140
  Gene Symbol: C12orf76
  Gene Name: chromosome 12 open reading frame 76
  ENST ID: ENST00000549724
  CDS Start-End: 605-823
aggcaggcccaggcctggtttcgggcctggcgccgggctgcccgtctttggtttcacttccttgttgtttcttcttaaaacaggtactgagtataaaacaatataaaacaaaatgagagggtctctctctcccccagtctctgggacagagcagagagcaagaacaaaatcgctgtgctcgtggactttacatgctagggcggagcaggtcctcagaaaatcatcaaatgcccgtaatgaaggtttaataagaaaatgcatggattcgtaaaaaatcttcaataggccccaaatggacctacaagacctcgaccccaatggatgagggaacgctaaccacagcagaacggtaatcgcggcgaacgttggcacagacggaaagttgatctgaacggaaagttggtccgggggaaacattagttattgaggaacgttaatccggaacaaatcttaggcagaagcggaacttagaccaggacgcacagttaccatggcaatgacgcgcgccctaagggcggtggcagcgacgcagagagacctgggaggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatg

SEQ ID NO: 118229 - DNA, 1580 bp, Homo sapiens
  Payload ID: 3140
  Gene Symbol: C12orf76
  Gene Name: chromosome 12 open reading frame 76
  ENST ID: ENST00000615315
  CDS Start-End: 1-408
ttttttttacaccagcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcc

SEQ ID NO: 118230 - DNA, 2633 bp, Homo sapiens
  Payload ID: 3141
  Gene Symbol: C14orf1
  Gene Name: chromosome 14 open reading frame 1
  Uniprot ID: Q9UKR5
  ENST ID: ENST00000256319
  CDS Start-End: 447-869
cgtcaccgccgcgcagcgcgggcgcagagccctgccctcagctgaagggagtcttcttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtg

SEQ ID NO: 118231 - DNA, 3082 bp, Homo sapiens
  Payload ID: 3142
  Gene Symbol: C14orf105
  Gene Name: chromosome 14 open reading frame 105
  Uniprot ID: Q9NVL8
  ENST ID: ENST00000216445
  CDS Start-End: 138-1028
tagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccagcactttgggaggccgaggtgggcagatcacttgaggtcaggagttcaagaccagcctggccaacatggtgagacaccgtctctactaaaatacaaaaattagccagacatggtggcattcgtctgtaatcccagctacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtatttctgcttcctagcaggacagctggcaaagagtttatcattaaatgtttgctgaattaatga

SEQ ID NO: 118232 - DNA, 1153 bp, Homo sapiens
  Payload ID: 3142
  Gene Symbol: C14orf105
  Gene Name: chromosome 14 open reading frame 105
  ENST ID: ENST00000422976
  CDS Start-End: 43-1053
ccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccgacagagtttcgctcctgttacccaggctggagtgcaatggcatgatctcggctcaccgcaaacttcgcctcccaagttcaaatgattctcctgcctcagcctcccgagtagctgggattacaggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatc

SEQ ID NO: 118233 - DNA, 1242 bp, Homo sapiens
  Payload ID: 3142
  Gene Symbol: C14orf105
  Gene Name: chromosome 14 open reading frame 105
  ENST ID: ENST00000526745
  CDS Start-End: 132-446
gatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaagtaagatgaatttaaaaggcttcataaggaatttcttggataaaatggaatgctgactgctctaaacgttgaacttctagaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccgatcgctgtgccgtgggccaaatccccacatcagcaggactgacccaccgctgagagagctgcagaaaagctggctatgtctctggaggtcttgaacttctaagacgcaaaattgcctgctgaaagagacactgctcctacttggagaaacaagacgctcgatcaataagttaattaaataagaaaaggctgaataattgaaaatctacttggggcatctatttaacctatacttccaagtctcagaatgaaatatcctttgtagtcacataaacaatttttaccatttaaaccgtaccttaaaaaatatacacaaaacaaccaagaaaaaaacctcacctaaagttagacatttaagagtcatcacttgagagcacgcc

SEQ ID NO: 118234 - DNA, 1057 bp, Homo sapiens
  Payload ID: 3142
  Gene Symbol: C14orf105
  Gene Name: chromosome 14 open reading frame 105
  ENST ID: ENST00000534528
  CDS Start-End: 43-267
ccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactgcatccagagacatgtattttgacatcccactggaacacagagaaacaagtattattaaaaggcatccaccccaaagacttcaagtaagatgaatttaaaaggcttcataaggaatttcttggataaaatgaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatc

SEQ ID NO: 118235 - DNA, 1030 bp, Homo sapiens
  Payload ID: 3142
  Gene Symbol: C14orf105
  Gene Name: chromosome 14 open reading frame 105
  ENST ID: ENST00000534126
  CDS Start-End: 43-930
ccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatc

SEQ ID NO: 118236 - DNA, 583 bp, Homo sapiens
  Payload ID: 3142
  Gene Symbol: C14orf105
  Gene Name: chromosome 14 open reading frame 105
  ENST ID: ENST00000524996
  CDS Start-End: 1-410
aagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccgacagagtttcgctcctgttacccaggctggagtgcaatggcatgatctcggctcaccgcaaacttcgcctcccaagttcaaatgattctcctgcctcagcctcccgagtagctgggattacaggtgcctgccaccacgcccagctaacttttgtatttgtagtagagacgaggtttcaccatgttggccaagctggtctcgaactcctgacctcatgatccgattacaggcatgagccaccgcgcctggccacaattgatgtcttatagtgaaaacagtcatatgcttcagggatgtgtcactttgaatccattattttaatgtcagcttcaaaattctggtcttatctggccacctgcactctttctataaagaatcttgttttatttta

SEQ ID NO: 118237 - DNA, 598 bp, Homo sapiens
  Payload ID: 3142
  Gene Symbol: C14orf105
  Gene Name: chromosome 14 open reading frame 105
  ENST ID: ENST00000526336
  CDS Start-End: 132-446
gatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaagtaagatgaatttaaaaggcttcataaggaatttcttggataaaatggaatgctgactgctctaaacgttgaacttctagaagcttgaacccattgacttgccacgagtaattacttcaggaagactcctgagccagcgagaagccaggacaatgcacaaa

SEQ ID NO: 118238 - DNA, 1022 bp, Homo sapiens
  Payload ID: 3142
  Gene Symbol: C14orf105
  Gene Name: chromosome 14 open reading frame 105
  ENST ID: ENST00000529860
  CDS Start-End: 144-368
cagagctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactgcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccgggcaaacccacagttgaaatttccaatattgttcacacacacagatcgctgtgccgtgggccaaatccccacatcagcaggactgacccaccgctgagagagctgcagaaaagctggctatgtctctggaggtcttgaacttctaagacgcaaaattgcctgctgaaagagacactgctcctacttggagaaacaagacgctcgatcaataagttaattaaataagaaaaggctgaataattgaaaa

SEQ ID NO: 118239 - DNA, 1187 bp, Homo sapiens
  Payload ID: 3142
  Gene Symbol: C14orf105
  Gene Name: chromosome 14 open reading frame 105
  ENST ID: ENST00000530417
  CDS Start-End: 153-467
gcagtgaaacagagctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaagtaagatgaatttaaaaggcttcataaggaatttcttggataaaatgaagcttgaacccattgacttgccacgagtaattacttcaggaagactcctgagccagcgagaagccaggacaatgcacaaagcaaaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatc

SEQ ID NO: 118240 - DNA, 3660 bp, Homo sapiens
  Payload ID: 3143
  Gene Symbol: C14orf119
  Gene Name: chromosome 14 open reading frame 119
  Uniprot ID: Q9NWQ9
  ENST ID: ENST00000319074
  CDS Start-End: 857-1279
gggctcgcgctgctgccgttaaggcgggaaccggcgcgatctccattccagcgcgaacctcatcaaccaccgtgcgcgcggatccagaggctcgcgctggcggcctgagcgagctcgcgccgagcccggatactgcgcctgcgccgcggcagaggctcgtctctaccgggtccgctctcctccgacaccccagcaacgccgactcctcacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccgaagctttgaatcgaatatattcggaaaccctcgaccctggtataaccataatcggagatgttcgtttatttccggacctagagatgaggcgctggggcgcttgggtgtttggggcgggtccgaggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagttttcccagtgatgatttaataaaattatgaaaaatcaggagagggagataattagttgcttcctccttcacactgtttgaatcgaactcgcggtgacttttttttttttttaaaaacatgggttgtcacttaagtttggagtgcagtggcatgatcatcagtgagcgtgagatcactgtaacctcaaattctaggctgaagtaatctttctgcctcagtctcctgagtatctaggactacaggcccgcacaacaatatctggctaatttttaaattattctgtagatacaggggtcatgctacgttttctagtctggtcttgaactgctggcctcaagcgatccattctcaccttggcctcccaaagtgctgggattacaggcatgaaccatcatacctggcctttttctaaggcatatgtatgtgatattcttggaactggtagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagaggcattccaaagaaagtagaaattaagtatacacaatagattttccatccagttgtctcacaagaaattattctcttccttaccccctgtcatgttctgggcaacatcacacctcccttattcctctaactgggacccttgtgctgtggagctctggtgaatggtaagaggcagatggtctcacaggaagagtggctcttttctggtaggctgtggttcccattacacccaccaggattagcagcattaggcagagtcccatggacagccttaggtgggtcatggagggattatggtctgaagtaaccagcaacctaggaacatagaaggtaatatttggcatggaataatgcctagccttagtagataaagcggcattacctttttttttttttttttttggagacaaggtcttggtctgttgcccaggctggagtgcagtggtgtgatcttggctcaccgtaatctccgcctcccaggctcaagcaattctcctgcctcaaccttccgaatagctgggactacaggcgcacgccgcaccaccacgtctggctaaggggctttacccttaaagatagagctcatgaagccccgcctcatccaagcattaagctaaacaggaaatcattaagagggactatcgaaccttaaagtagaaataagatcaagatctaagtcttctagcatcttatattattggaagaagacctaacttggcagcaagggaagtggcttaagggaagagtcagtctatgttctttaggtagctagacacaatccctaacagtgcttaagaaaggaagggggctgggagtggtggcagtggctcccagcactttgggaggcagaggccggtgggttgctttagctcaggagttggagacaagcctgggcaacatggtgaaactgtctctatcaaaaatacaaaaattagctggcatggtggtgtgcacctgtagtcccagctacttgggaagctgaggtgggggaatcacttgagcctagggaggtcgaggccacagtgagctgagatcaccccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccgga

SEQ ID NO: 118241 - DNA, 725 bp, Homo sapiens
  Payload ID: 3143
  Gene Symbol: C14orf119
  Gene Name: chromosome 14 open reading frame 119
  Uniprot ID: Q9NWQ9
  ENST ID: ENST00000554203
  CDS Start-End: 113-535
agcttagggttttcaggaaatttggaagctgccgcagtagttggagtctaaggactcgtgacaatcttcgggtgcccttcgagagaaaaggggagtgcttttatgtttcaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatg

SEQ ID NO: 118242 - DNA, 1154 bp, Homo sapiens
  Payload ID: 3144
  Gene Symbol: C14orf142
  Gene Name: chromosome 14 open reading frame 142
  Uniprot ID: Q9BXV9
  ENST ID: ENST00000306954
  CDS Start-End: 58-360
atttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtaacggaattattcgaccctctggtacagggggaagtgcagcaccgggtggcggcggctccagacgaggacttggacggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaata

SEQ ID NO: 118243 - DNA, 398 bp, Homo sapiens
  Payload ID: 3144
  Gene Symbol: C14orf142
  Gene Name: chromosome 14 open reading frame 142
  ENST ID: ENST00000556566
  CDS Start-End: 1-238
gctgggagagtacgtcgggcaggaagggaagccgcagaagctgcgggtgtcctgtgaggcgccgggtgacggcgaccctttccagggcctgttgtctggcgtggcccagatgaaggacatggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaa

SEQ ID NO: 118244 - DNA, 1154 bp, Homo sapiens; identical to SEQ ID NO: 118242
  Payload ID: 3144
  Gene Symbol: C14orf142
  Gene Name: chromosome 14 open reading frame 142
  Uniprot ID: Q9BXV9
  ENST ID: ENST00000621279
  CDS Start-End: 58-360

SEQ ID NO: 118245 - DNA, 398 bp, Homo sapiens; identical to SEQ ID NO: 118243
  Payload ID: 3144
  Gene Symbol: C14orf142
  Gene Name: chromosome 14 open reading frame 142
  ENST ID: ENST00000629526
  CDS Start-End: 1-238

SEQ ID NO: 118246 - DNA, 2967 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000256324
  CDS Start-End: 303-2168
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccatcctgctccatcctacctaggacgtgaatcctccctttgtccagggtacccgtgctgtctacaccacccgcctgccagtcacccagcaggtgatcagatcgactgtcatggtattgcagtgcttatattcaagaacctcttatgtgactcagtaatgtcctcaaagtgcaagagcagagatgctggcaatttggatatgccaaaaagaggccataaagggcttcctttaagtgaaaa

SEQ ID NO: 118247 - DNA, 642 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000298858
  CDS Start-End: 163-642
caggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaa

SEQ ID NO: 118248 - DNA, 2591 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000412671
  CDS Start-End: 163-2028
caggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccat

SEQ ID NO: 118249 - DNA, 2538 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000428926
  CDS Start-End: 169-2019
attctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 118250 - DNA, 2856 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000522322
  CDS Start-End: 484-2334
cgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118251 - DNA, 558 bp, Homo sapiens
  Payload ID: 3145
  Gene Symbol: C14orf159
  Gene Name: chromosome 14 open reading frame 159
  ENST ID: ENST00000522837
  CDS Start-End: 302-558
gttgcttggcggggaggcaggagagggaggagcgccgccactccgattgatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccag

SEQ ID NO: 118252 - DNA, 650 bp, Homo sapiens
  Payload ID: 3145
  Gene Symbol: C14orf159
  Gene Name: chromosome 14 open reading frame 159
  ENST ID: ENST00000523879
  CDS Start-End: 400-650
agcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaaggtctcactctgttgcccaggctggagtgcagtggcgtgatcttgattcaccgcagccttgacctcctgggatcaagtggtccttccacctcaacctcccaagtagctaggactacagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcaga

SEQ ID NO: 118253 - DNA, 3075 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000518868
  CDS Start-End: 691-2556
aagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaagttacagattacgaaaatgatagaaccagaaggtgctaacaaaatgtctgtcctgcatgtgtggcatttgacatgaagaaactgaggcccttgctgggcgcagtggctcatgcctgtaaccccagcactttgggaggccaaggcaggaggatcacttgagctcaagagttcaagaccagccttggacaagatagtgaaaccttgtctctaccaaaaaaatacagaagttagccaggcatggtgcagtgtacctgtagtagcagctactgaggaagctgaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 118254 - DNA, 1060 bp, Homo sapiens
  Payload ID: 3145
  Gene Symbol: C14orf159
  Gene Name: chromosome 14 open reading frame 159
  ENST ID: ENST00000519950
  CDS Start-End: 457-1060
gggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacc

SEQ ID NO: 118255 - DNA, 2435 bp, Homo sapiens
  Payload ID: 3145
  Gene Symbol: C14orf159
  Gene Name: chromosome 14 open reading frame 159
  ENST ID: ENST00000523461
  CDS Start-End: 1-1694
ggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggagagcaaagggagaaagctctaggctaaaggccagaagacctagccctgccaataaaatcaacctcattttgtgaatgcctgttgtgtgccaaggaccctgctaagtgctttgcttgaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcaga

SEQ ID NO: 118256 - DNA, 827 bp, Homo sapiens
  Payload ID: 3145
  Gene Symbol: C14orf159
  Gene Name: chromosome 14 open reading frame 159
  ENST ID: ENST00000522816
  CDS Start-End: 1-827
tcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaagtcaggctggggcaggtgtcagggtgtccctgagccaggcttgatggtggcagcaggtggcctatgccaaggagagctcccacagccagagcagaaggaggtgaaggccaagacagagctggggcctccagatgccatgtggcgtcatgtgggactgtctgtctttccccgtgtggctgggaggcagatggagccgtttctcccgctgccacactccccagcccggtccaggcagccagctctcccctgcctattgcaagatgagaccatgattataccagccccatcttgctctacgggaagcctcagcaccatgttcccgcct

SEQ ID NO: 118257 - DNA, 1597 bp, Homo sapiens
  Payload ID: 3145
  Gene Symbol: C14orf159
  Gene Name: chromosome 14 open reading frame 159
  ENST ID: ENST00000517518
  CDS Start-End: 303-1597
tggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctag

SEQ ID NO: 118258 - DNA, 2294 bp, Homo sapiens
  Payload ID: 3145
  Gene Symbol: C14orf159
  Gene Name: chromosome 14 open reading frame 159
  ENST ID: ENST00000517306
  CDS Start-End: 1-1520
cctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118259 - DNA, 2764 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000523816
  CDS Start-End: 392-2242
ccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118260 - DNA, 622 bp, Homo sapiens
  Payload ID: 3145
  Gene Symbol: C14orf159
  Gene Name: chromosome 14 open reading frame 159
  ENST ID: ENST00000521081
  CDS Start-End: 548-622
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaac

SEQ ID NO: 118261 - DNA, 2814 bp, Homo sapiens
  Payload ID: 3145
  Gene Symbol: C14orf159
  Gene Name: chromosome 14 open reading frame 159
  ENST ID: ENST00000523837
  CDS Start-End: 246-359
cctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggaggatttcattgaacagtaactttagtccctgcttcctgaacaccgaggtgctcaataacttacatacattacctccctgaggtctcttggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccaggggtctccaggggcaaaggccctgaacaaggctcaaaggctctggcagctgtatcagggctgggcttacagatgcccctcaggtttaaagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118262 - DNA, 550 bp, Homo sapiens
  Payload ID: 3145
  Gene Symbol: C14orf159
  Gene Name: chromosome 14 open reading frame 159
  ENST ID: ENST00000524232
  CDS Start-End: 394-550
gtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttg

SEQ ID NO: 118263 - DNA, 959 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000518665
  CDS Start-End: 450-929
gatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaa

SEQ ID NO: 118264 - DNA, 484 bp, Homo sapiens
  Payload ID: 3145
  Gene Symbol: C14orf159
  Gene Name: chromosome 14 open reading frame 159
  ENST ID: ENST00000518871
  CDS Start-End: 158-484
gagaggagctcagagaagcgagagcaaagggaagggtttgtgacgcagatgagagcaggaagagaaaaaggctctggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcag

SEQ ID NO: 118265 - DNA, 544 bp, Homo sapiens
  Payload ID: 3145
  Gene Symbol: C14orf159
  Gene Name: chromosome 14 open reading frame 159
  ENST ID: ENST00000521064
  CDS Start-End: 168-544
cttctcgagccagctctctctgtggggtgacaaatgaccactggcagcctatgctcacattgtccctgtgtctagcagtttcagaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagctt

SEQ ID NO: 118266 - DNA, 2687 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000520328
  CDS Start-End: 474-2168
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 118267 - DNA, 862 bp, Homo sapiens
  Payload ID: 3145
  Gene Symbol: C14orf159
  Gene Name: chromosome 14 open reading frame 159
  ENST ID: ENST00000523894
  CDS Start-End: 407-862
aggtgacaaagctaatcgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaag

SEQ ID NO: 118268 - DNA, 2976 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000523771
  CDS Start-End: 604-2454
gggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggtgactttgcgggggtctcttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118269 - DNA, 583 bp, Homo sapiens
  Payload ID: 3145
  Gene Symbol: C14orf159
  Gene Name: chromosome 14 open reading frame 159
  ENST ID: ENST00000517362
  CDS Start-End: 390-583
actgaggcccagctgttcctctccttgaaaagtcaaggcttggttcaagccagatagcacctgaggacagaacatatcagaagacacaggaagggctctgaatggactcgcttgggacctctgctcaccccctgtattaaataaccaccgaggccagatgagtggaaataccctggttagttggcctgagtcacatggcactattgatgggacagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccct

SEQ ID NO: 118270 - DNA, 591 bp, Homo sapiens
  Payload ID: 3145
  Gene Symbol: C14orf159
  Gene Name: chromosome 14 open reading frame 159
  ENST ID: ENST00000517877
  CDS Start-End: 55-315
gccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggtaaaaagcttgggttactgtgggttgaagcttgggagtgtccaggtgctgtagccaggtgtctctgtcatccgggacctctctgtccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatc

SEQ ID NO: 118271 - DNA, 1148 bp, Homo sapiens
  Payload ID: 3145
  Gene Symbol: C14orf159
  Gene Name: chromosome 14 open reading frame 159
  ENST ID: ENST00000519994
  CDS Start-End: 215-529
acagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagagatggggtctccctgtgttgaacccctgggttcaaacaatcctccctcctcagtctcccaaagtgttgagattacaggcatgagccaccgctcctggtgctctggggaaccgggggattgggcacctgctctgtaaagatgagctgctgaaggcctctctctcgctgtcccatgcccgctcagtgctcatcaccactg

SEQ ID NO: 118272 - DNA, 909 bp, Homo sapiens
  Payload ID: 3145
  Gene Symbol: C14orf159
  Gene Name: chromosome 14 open reading frame 159
  ENST ID: ENST00000521334
  CDS Start-End: 454-909
agtccgcagctcgtgcttgacagtgaggagctgctctcctccgtcgccgccgtccgcgctggtccccgcggcgccgccgctgctgccaccctcctcctccatcttctcctttttttccgatcccgcgggtcgctacgaggggaacccaggagacagcggacgcccgtcccctcgcagccgctgccgcggccccaggagtcggggtgcggcggctccagaactcggacgcaaagacgagtctctttcccgctctggccgcacggctcgctcctcgcctcctcccccttcggcgggcaccgctagtaccgcgcaaccaaaccgccccctgctccaccgccgcctcctcaggccgctccgcccacagccagcaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaag

SEQ ID NO: 118273 - DNA, 2719 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000521077
  CDS Start-End: 452-2197
cggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 118274 - DNA, 834 bp, Homo sapiens
  Payload ID: 3145
  Gene Symbol: C14orf159
  Gene Name: chromosome 14 open reading frame 159
  ENST ID: ENST00000519019
  CDS Start-End: 394-678
caccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaac

SEQ ID NO: 118275 - DNA, 853 bp, Homo sapiens
  Payload ID: 3145
  Gene Symbol: C14orf159
  Gene Name: chromosome 14 open reading frame 159
  ENST ID: ENST00000522170
  CDS Start-End: 247-853
gagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccag

SEQ ID NO: 118276 - DNA, 2471 bp, Homo sapiens
  Payload ID: 3145
  Gene Symbol: C14orf159
  Gene Name: chromosome 14 open reading frame 159
  Uniprot ID: Q7Z3D6
  ENST ID: ENST00000525393
  CDS Start-End: 163-1908
caggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccat

SEQ ID NO: 118277 - DNA, 7075 bp, Homo sapiens
  Payload ID: 3146
  Gene Symbol: C14orf166
  Gene Name: chromosome 14 open reading frame 166
  Uniprot ID: Q9Y224
  ENST ID: ENST00000261700
  CDS Start-End: 166-900
gcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaatttttattatgtactgtatgtttgcataaatcacctttctcctttgtggttaaggcatatatgccaacccccagctttgtcctagagacaatatagatccttaagtcataggaaaacttaaaacactttattggagtaatctagaaaattttaaaattgttacatctttggtatttataaatgtgatactttactttctgtgggtacttctatagaggcactacaggatcagaaaatgcaaattgaatcattttagcaccttttgatataaatagaaatgcactgatgcagaggtaaaaaatcttagaacttttgttgggaaactataaataattggtcctttcccatcagttctgcattggcttctccaactgtcaaggtttaggattatattgttatattgatcacatgtgctttaatttcttggccagaaggaatccatggcaaaaatcaggtttagagtcttaaactctaattcttagttgaatgaatttgatcttttaaatattaatgataaatgtttacaagaagttgctttaataagcaacagttaaaattctgttacctttttaaacttgcaataacaaccttcatttttaaaaatacagtagtaaagattgaggtatcagcttttcacaaaagtctttttgcactacaaaatgttcatcttggatgctcaggaacgtctaatggccaattccttttttactttctttgcctttgcagtcactgttctttagggtccaggttctgattgtaaactccaagtcttcctttacattactgtacttactttcttcctgtgagagaagagcaggggtgggacagggtggtgggtgagtatattgtaaccaagttgcaacagcaagtctttgcattttgtgtataaactaggtagatttaaggtagtaaagactggccctcagggcaggaagaaggcaatggtggcagtgtcacaggcagcaggggtaatcaaataccatatatatcccttctctaccctgctaatttaaaggagcatcctaaagcatactttttacctgttgggcagtaggggtagactgcagttatcccgtagaggtgagatcgttgttctgggagatactcatcagtaaactggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctctaaatccattgctcatctctagctgcatgttagaatcacatgatgagctatcaaatcagagttgtagggcatggtgtaaagggcttagactttaatgttccacagttcctcatttgagaactagtctaaatagtatttttcggtccctcagacaatatgtccacagtgtcaaaagccaacttaagccctgtaatatagctcatggtatcaagggtagtcttattctctaaagaacatatttagattaatatgctcccttttgagacattatccaatagctttgctactttttaagctatatgtgagcaataccattcgatttctgggtgaagtaaaaggatgatttcaaaaacatgaaaggatgaaaaacatccttgaaggatcttatctgccaatgaggaggtgatgaaacaaaagcctcagagggcttaatgagtcaagtcaggtactgacttttggtaaaacaagtggtgtgtcctctggaacagttggccttttcaggcttgtccagaatttgtggggctcacctcctccagtctgtgtggtagaagtgatctgcatagcttacgatgctgaaggggtacttgaggttgttttgaatgacacgccgtccagttccatcaggtagtgtacactccagttttttggttccttttaaaacaaagggggaaaatgaggtccttcagctgctttgccaaaaatgatagtgacatagtgatagtgacacagtgatagaatggggaaataggatattttacttccattacagtcatagattagcaactgtaaaattacctgtcctattactagtctccagtttttagtagagattcaaactttcaatccttttttggaagacaggattgcatttactgaaatctggtaagtttctgccaaagtagggcattaaacataattatttttataatttgtgtgatttcaagccttagcttataaattataacatctgggtaaatacttgccctttgtaagctatgtctataattactgaggcaaccttttaaccaaaatccttagtatttttaaaatattttctaggtaggaggaaaaaagtgactaaaatggtaacataactcatatttcaatgtaaaggaatcagtcttaaaaatttttacaatagctaaaccattcaagaatttccaagtttcacatttctcatggagccgatttaaatttcaaatccttttaagaaatgtaacttgttttaaacaactgggttataaaagtgacctatgtacattaggcccttttattagattacaaattcaagaacagtctttttcatattctttagtatagaactagacacacagcattttttcagttgtgctgataaaagcaaacaaatgtaggttgctaatacccatgttattactgaaggaagctaccctgctacaatgctttccaaagaatgtccttagcattataacagatgtttataggtaagttatagtgaccctctccccgcataagaataacttcacttaagtttgtcaattcaacaatggctaattcttttaactgttaaaaatatgccaggcactcatggtcaggcaagcagtacaaacttactgcttgatatatccttccctccacccaaaccccagaaagttcattttaagactcatttactagtacttaaatttactagtacttaaaagtttacagaccaaagaaaggagatctaagtgatgggatttcattttgtagtaaaatctgttagtgctcacattcactgtgatgagaggttatctatttgcattccatcagtagtattacctgcatctgcccagcagagcagtttagagaaagggtcaaaggttaagccattgggcaatccaatgtctgtattgatcagaattcttctgttttctccatctaaagatgacgtttcaattttaggagcttctctattccagtctgtccagtacaagttgctgtaagttaaaaatcaagattgtaaaagaatagccatgtagcctgtggtaggcagcatctaagcagcccccagtgatctccatctcctcatgtattatagccttaagcaatccccttgagtttgggctgcattagtagtgtcttgcttcttctagtgcatagagtatagcagaagtgataggctatcactgccgatattcggtctcaaaaaactggtttctgccttaggggctctctcttgctccctttgagggaagctggatgccatgttgcaagctaccctgtaaaggggaacatgtgccaaggaactgatgtccttgagggctgttggccagagacattagtcttgcctgtagcccatgtgagcatgcttgggctgtgtcttccccgagctgagccttgtgatcactgcagtttggccattacctgattgcagccttgtgagagactccatgcctgagggagctcggtgaagacacacttggattcctgactcacagaaactgtgagactaaatgttatcttacactgctgagggtttgggcaatttcttacacagcagtaggtaactaatacacagccatattccacttttacctgtatcacaaggttttctgattattgtcactatgtgggagaagtcattactaagttactatcagaatccctgcctccaagataccccttgactcaactgccccaaaaccctccgtttgttgaagtcttgaattggatcttgggttttagaatagaaacaaatacagctgttaggaatggcttcgatacaaactatggaacttgaagagatgtggaccagggatttgagaaggaaactgttctttcttctgccaaaaatacaatttggtacttgaaggggtacctggcacccagggatggaaacattttaagttaagcactttaccttttaaatgccacgttaaaaatgaaatatattcataacagatactaacgaggaaatatggtcctattaagtggaaataggttataaggaaacaaacaggtttatcgttagagcagaaataatgttgaaagcactttttataaaatactattttataaaagctatagaagctttgaataaatcagttgggctacagagaacctcagtgagaggagaggaagaaaccataggtttcccctgttgcgaatttcatcccttatgcccaacagatgaagcagagagaagctgagagcaaaagctagaaagcagtttccactttgcgctaaggtggaggtggccagagggtacagcatgcatatcattgcttcatcgcttctgatcagtctcctccccaaaatgatttaatatcatcaacaacaataagtctgaaacaagctcacacagatatttggtgtaaattatttggggattgccagaggaagaaagttgtaaaggtgaaatctatagaaagcaaatgagaaatatgcaggaaggcttgacaaccattctgttacgcagttgaaggagatgtaattacatgtgttatattgcaacctggttcaaggtgggttttctttttattaaaaattcaagtcctttagcatttatatttgctgtctggataagaaagttctactttcatatttaaactcatggctgtgatgtggatttcagcttaaaagtatgctttttccccagactccagagacatggccaaagtttcattgcctacaagatggcagctctccccagttttcaggtcaagcaccaagaaggaataaggggccgggcgcagtggctcatacctataatcccagcactttgggaggccaaggcaggtggatcacccagggtcaggagttggagaccaaaatggcgaaaccctgtctcgactaaaaatacaaaaattagctgggcatggtggcacatgcctgtagtcccagctacttgggaggctgaggcaggagaattgcttgaacccgggagatggaggttgtagtcagccgagactgtgccactgcaccccagcctcggcaacaaagcaagaccttgtctcaaaaaaaagaaaaaaaaaagaaaaaaggaccttccaaatgtccaaatgtcagaaaggcaagcctatgcaaagagtttttaagagggctattaattcctgttaagtcaactggaatagagaaggatacaggtacttttcctgtgtgtagaacccaaagtttgaaaccacctttgaggcactgcactaagtatttcatagtcaaaaagcacttacctgaaaattaaagctgaaggttttctttactgatttgaagggcatctgggaatttcatttcgtagaaactccacttaaacatggcaagagtttctcaagatataaaaattctccctgattgtaacaagtactgagacagtgaacaaatcctgtatgtcacatttgatgaccttagcaattatacagacagggaaaatgtttatcttgatttctgctacagcaacactgaagccagaggtgtctgagctttggctaatgtcacttgatgtaggtcagccctactgtgagcgtcaaccctggtttctaaatgtgctgctggaggaatcccacttcacttccagtttaagtgtcagctgaggcctcgcctgatcatttgattcagagtagccctagttctcacaacactatctgaattttctacatatcacatcacagactaatattgtttataccagtcttgtttcctcctaataaaatataagtgccatgaaa

SEQ ID NO: 118278 - DNA, 683 bp, Homo sapiens
  Payload ID: 3146
  Gene Symbol: C14orf166
  Gene Name: chromosome 14 open reading frame 166
  ENST ID: ENST00000553362
  CDS Start-End: 1-390
ctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaattttta

SEQ ID NO: 118279 - DNA, 851 bp, Homo sapiens
  Payload ID: 3146
  Gene Symbol: C14orf166
  Gene Name: chromosome 14 open reading frame 166
  ENST ID: ENST00000556760
  CDS Start-End: 26-607
gggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccacca

SEQ ID NO: 118280 - DNA, 557 bp, Homo sapiens
  Payload ID: 3146
  Gene Symbol: C14orf166
  Gene Name: chromosome 14 open reading frame 166
  ENST ID: ENST00000557553
  CDS Start-End: 127-333
gtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagag

SEQ ID NO: 118281 - DNA, 2429 bp, Homo sapiens
  Payload ID: 3147
  Gene Symbol: C14orf169
  Gene Name: chromosome 14 open reading frame 169
  Uniprot ID: Q9H6W3
  ENST ID: ENST00000304061
  CDS Start-End: 55-1980
cgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggccgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatg

SEQ ID NO: 118282 - DNA, 1284 bp, Homo sapiens
  Payload ID: 3148
  Gene Symbol: C14orf177
  Gene Name: chromosome 14 open reading frame 177
  Uniprot ID: Q52M58
  ENST ID: ENST00000325812
  CDS Start-End: 420-797
aagatgcattatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagccacagcactcgcaaaaccccacagatacagtgccaatgacagaaattaagattaactgggggcgacacagatttctgtgaatgccagtgctgtcagatgcttcctgatagtactttctagagtaaaagaacttcgggaaaagtaaaagcagcaaatggtaacaccctcatggagatctcagggtgtagaggcaagcactgaaggcccatgatcagccgtgggagccacgggaatcaattgcttccagtacgactggatgcatcggaaagagcctggggcaaggctggaggccacaagaggagctgccaggccacataagcagggaacaaagccgatgatcacacgcccatcagtgagccaacttggtgaagggaaatgcccaagttctcagcacctgcagagcctaagacataacaagcagcatgccctgacgctcaccaaggccaggtgctgtggtgagtgctctacctgtttctgtacagaagagaaatcagaatgccagagacatgaagaaacttctccagggtcatgtaatcaccaaataatgtctgcttcgaccatctctgcattttgtgctacaccaagatttaagcagctgttcaaaggaactgtagaacagatgtcacagatgtaactattcttgaaaggaagtcagatttcatagatggaaagactgcccttttccatttgcctcctccagacccataactttggataggggggttttattgtccgtgaggcttatgcatatgtcagaagaatgtccaagcagaggaatctaagtggcagaccccccaggataggaaagaagaaggacgctcgtgctgacacttccagaacactcttcacgttttgtgacatatgtgcttgtcgagtgatcttaagacagctggatgtccgaaccatgcagtaatagcagagaacctgcggaaggagaagcttcccaggacgttctgagggcttatgccgggtgcaggctttccttcccgcaacatccctgagtccagagaagaaataatcccctgccctgtgggccaagcacttacagcaacagcactttgagtttgctgtgcttagattcacttgtggaacttgttaaaaatataaaattccagacccca

SEQ ID NO: 118283 - DNA, 467 bp, Homo sapiens
  Payload ID: 3148
  Gene Symbol: C14orf177
  Gene Name: chromosome 14 open reading frame 177
  ENST ID: ENST00000541516
  CDS Start-End: 243-467
attatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagccacagcactcgggtgtagaggcaagcactgaaggcccatgatcagccgtgggagccacgggaatcaattgcttccagtacgactggatgcatcggaaagagcctggggcaaggctggaggccacaagaggagctgccaggccacataagcagggaacaaagccgatgatcacacgcccatcagtgagccaacttggtgaagggaaatgcccaagttctcagcacctgcagagcctaagacataacaagcagcatgccctgacgctcaccaaggccaggtgctgtggtgagtgctctacctgtttctgtaca

SEQ ID NO: 118284 - DNA, 642 bp, Homo sapiens
  Payload ID: 3149
  Gene Symbol: C14orf178
  Gene Name: chromosome 14 open reading frame 178
  Uniprot ID: Q8N769
  ENST ID: ENST00000355883
  CDS Start-End: 210-578
caagatgctcacgcgaaaaacccactcttcagtgtctgagaccactccgcagctttcggcctcggtgagcgggtgaactaaacccgggaaaccgctgaaagaccccagcttcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctggcatgatcaaccagagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaatatcaatttattcttc

SEQ ID NO: 118285 - DNA, 632 bp, Homo sapiens
  Payload ID: 3149
  Gene Symbol: C14orf178
  Gene Name: chromosome 14 open reading frame 178
  ENST ID: ENST00000439131
  CDS Start-End: 290-568
cccgcaagatgctcacgcgaaaaacccactcttcagtgtctgagaccactccgcagctttcggcctcggtgagcgggtgaactaaacccgggaaaccgctgaaagaccccagcttcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctgagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaatatcaatttattcttc

SEQ ID NO: 118286 - DNA, 474 bp, Homo sapiens
  Payload ID: 3149
  Gene Symbol: C14orf178
  Gene Name: chromosome 14 open reading frame 178
  Uniprot ID: Q8N769
  ENST ID: ENST00000557011
  CDS Start-End: 70-144
cgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctgagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaata

SEQ ID NO: 118287 - DNA, 546 bp, Homo sapiens
  Payload ID: 3149
  Gene Symbol: C14orf178
  Gene Name: chromosome 14 open reading frame 178
  Uniprot ID: Q8N769
  ENST ID: ENST00000556047
  CDS Start-End: 70-183
cgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctggcatgatcaaccaggtacagaatcagttttttggctgtagatgatttaagagttagggtcaacttgtctttgagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaata

SEQ ID NO: 118288 - DNA, 1455 bp, Homo sapiens
  Payload ID: 3150
  Gene Symbol: C14orf180
  Gene Name: chromosome 14 open reading frame 180
  ENST ID: ENST00000331952
  CDS Start-End: 257-790
acaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggt

SEQ ID NO: 118289 - DNA, 2009 bp, Homo sapiens
  Payload ID: 3150
  Gene Symbol: C14orf180
  Gene Name: chromosome 14 open reading frame 180
  Uniprot ID: Q8N912
  ENST ID: ENST00000410013
  CDS Start-End: 502-984
gttccagtggtgagcgttgggctgggagccaaggcttttcccaggagcccagccaccccgcctggctgtgttctgcctccgccctgcagaggaaaggccagcgaggcagtgtccatggtcccagtcttcttccaccggaagaaggcacaacctgcatctgcagccccagggccattgggttaggcctgtggccaaactactaaggtgctgggagactgaggaggcccagctcctcctggggccaccaagcccgtggttgacggcctccccatggaccgggctgtcccgagagcagcaagtcagccggggccctcagggccgctgaggccactgctcagtgtcgccgtaatggaaacttctcagctggttgtgagccgcaacagctctggttcacaccctgcgacagcgaggctgtgaccgccagtggatctcggggctgatcaggcctgagccaccccggaggtacagcaccagcaggagcccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgg

SEQ ID NO: 118290 - DNA, 2551 bp, Homo sapiens
  Payload ID: 3150
  Gene Symbol: C14orf180
  Gene Name: chromosome 14 open reading frame 180
  Uniprot ID: Q8N912
  ENST ID: ENST00000557649
  CDS Start-End: 337-819
agaggtaattatagcctggccgctgccagctggcccagctttgcgatccagcagagagggctggagacgggacgaaggccacaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtcttggtgtttttatagaaatgagagaaaccagaaccgatttgctaaggaatcggcctcagtggccaaagcggatgtcctgggcgcctggaacctccccatctcctgcaggcctgggagtggatgtgtccactcgggcaggggctgaccaagcccctgggtcttgagggatgcccggccggctccctttgccctgcagtcagggtgtgtccctgcaactccaggtgccagggaacaggtgaagtggtctccagggtcacttccagctttggaatccagggagcccagagttgcgggtggaggtaacaaaaggggctgtttccagaagtggcccagaagggaccatggtgggggctcccccggggaccctccagcatctctccccaggcccagcccatcccaccccaccccaggaaggaggatgggcaggttcctgccccatattctggatgcagaagcagcggctcccagaggttgggtctctcagagcagtcacaggcccaggctcagccctgtgtgcttgggacacccctccagccccggttctgacgggggacaccgcacaggccgatctcccccagccgctgctgtctgtccactgcaaaggcaacgcaaggacgtgcctggctttgcggggtcccacgctacgacctcaggtgttttcgaat

SEQ ID NO: 118291 - DNA, 2009 bp, Homo sapiens; identical to SEQ ID NO: 118289
  Payload ID: 3150
  Gene Symbol: C14orf180
  Gene Name: chromosome 14 open reading frame 180
  Uniprot ID: Q8N912
  ENST ID: ENST00000618752
  CDS Start-End: 502-984

SEQ ID NO: 118292 - DNA, 1455 bp, Homo sapiens; identical to SEQ ID NO: 118288
  Payload ID: 3150
  Gene Symbol: C14orf180
  Gene Name: chromosome 14 open reading frame 180
  ENST ID: ENST00000619279
  CDS Start-End: 257-790

SEQ ID NO: 118293 - DNA, 2551 bp, Homo sapiens; identical to SEQ ID NO: 118290
  Payload ID: 3150
  Gene Symbol: C14orf180
  Gene Name: chromosome 14 open reading frame 180
  Uniprot ID: Q8N912
  ENST ID: ENST00000630349
  CDS Start-End: 337-819

SEQ ID NO: 118294 - DNA, 643 bp, Homo sapiens
  Payload ID: 3151
  Gene Symbol: C14orf2
  Gene Name: chromosome 14 open reading frame 2
  Uniprot ID: P56378
  ENST ID: ENST00000286953
  CDS Start-End: 89-265
atcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 118295 - DNA, 842 bp, Homo sapiens
  Payload ID: 3151
  Gene Symbol: C14orf2
  Gene Name: chromosome 14 open reading frame 2
  Uniprot ID: P56378
  ENST ID: ENST00000414262
  CDS Start-End: 251-478
ggtgcgttctgagccgtctgtcctgcgccaagggagcgtaccttggccttgagaggttcagctgcctaacccagaggctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgaatgaaattgtatggaactcgcgggtcagacatttcccatttccagtgtcagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaactt

SEQ ID NO: 118296 - DNA, 472 bp, Homo sapiens
  Payload ID: 3151
  Gene Symbol: C14orf2
  Gene Name: chromosome 14 open reading frame 2
  Uniprot ID: P56378
  ENST ID: ENST00000557040
  CDS Start-End: 146-322
tctgagccgtctgtcctgcgccaagggctgttcgtttcttggaacctcacactgtcagagcattcgagtagcttgaggacaggaaatttgagggcggactatctgcaaggtgttccaggagaaggacacagtcgcatcctgcaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgca

SEQ ID NO: 118297 - DNA, 1058 bp, Homo sapiens
  Payload ID: 3151
  Gene Symbol: C14orf2
  Gene Name: chromosome 14 open reading frame 2
  ENST ID: ENST00000554713
  CDS Start-End: 52-351
gagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaactcctgggctcaagcagtcctccaatcttggcttcccaaagtgctggaattaacaagcgtgagccacaacacctggcccaattggggaactttgaacaagactttaatatcagaattataaaagaagtaaggctttgaaaggtaagatttttgcttctgaaaatggttgggaatggaaaacagcatcatgtcttttcaggacaaggtatatcgttgttctcaattgaaatcgaaacacagttcagtatatatgtaaggtgcagttgaaatgcttcacagcttgaagtttgctatgcctgctgggaaagagaattctgaatttctgctttttatagtcaagtggatcaagtaaaacttccaggagtaatagaggaatggattaattagaggtagtcgatatcatcaccaatagggaagcacaagtgagctgtgcaagcatgctgtcctagaagttccctaatgatgtcgttttattttgtttattgttttttgagacggagcctcgctctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccacccgcctcagcctacccgtaatgatgtgtttttaatggtttggttttgttttttgggtttttttttttttgagacagagtctcgctgtgttgcccaggctggagtgcagtggcacaatcttggctcactgcaa

SEQ ID NO: 118298 - DNA, 707 bp, Homo sapiens
  Payload ID: 3151
  Gene Symbol: C14orf2
  Gene Name: chromosome 14 open reading frame 2
  Uniprot ID: P56378
  ENST ID: ENST00000554880
  CDS Start-End: 155-331
agggtgagcctttctaggacctcaggggaagcttgagcgccgcggctggcccgggagtctgtttcacgggagttccgtggcaacccctgtgtgtacaagaaaatgccctccggtcactccctggcctctctatttagaggctgctgcctcggagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctact

SEQ ID NO: 118299 - DNA, 749 bp, Homo sapiens
  Payload ID: 3151
  Gene Symbol: C14orf2
  Gene Name: chromosome 14 open reading frame 2
  ENST ID: ENST00000555030
  CDS Start-End: 52-351
gagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaactcctgggctcaagcagtcctccaatcttggcttcccaaagtgctggaattaacaagcgtgagccacaacacctggcccaattggggaactttgaacaagactttaatatcagaattataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttga

SEQ ID NO: 118300 - DNA, 1659 bp, Homo sapiens
  Payload ID: 3151
  Gene Symbol: C14orf2
  Gene Name: chromosome 14 open reading frame 2
  ENST ID: ENST00000553430
  CDS Start-End: 61-294
gacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaaggtaagatttttgcttctgaaaatggttgggaatggaaaacagcatcatgtcttttcaggacaaggtatatcgttgttctcaattgaaatcgaaacacagttcagtatatatgtaaggtgcagttgaaatgcttcacagcttgaagtttgctatgcctgctgggaaagagaattctgaatttctgctttttatagtcaagtggatcaagtaaaacttccaggagtaatagaggaatggattaattagaggtagtcgatatcatcaccaatagggaagcacaagtgagctgtgcaagcatgctgtcctagaagttccctaatgatgtcgttttattttgtttattgttttttgagacggagcctcgctctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccacccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtatttttagtagagatggggttggccggctggtttcaaactcctacctcaggtgatccacctgccttggcctcccaaagtgttgggattacaggcgtgagccactgcgcctggcctttaatgtattttgaaagaaagcgccttataaatttatgccagagtgacaatgaaactgtagccatttgaatgttacacaaacccaggactggctacatgagtttgaggaggaggtgtttccctgcctctctctttgcgctgtgggtgaccactgcctgtctgctgtcattacatgaacccttaagcactctgggtgtttcatatagaaataatcctacttttcaatagtattgaaaggtgtcatttatctttttggactgttgatcaacttcttttgatacttgtttaataaattacatccaacttgttccttccttcttaaatcatatttatatatgcatctctttcaaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgcta

SEQ ID NO: 118301 - DNA, 2915 bp, Homo sapiens
  Payload ID: 3152
  Gene Symbol: C14orf28
  Gene Name: chromosome 14 open reading frame 28
  Uniprot ID: Q4W4Y0
  ENST ID: ENST00000325192
  CDS Start-End: 276-1208
ctccgtaataagaagcgacgtgtcccactgtcctggctccgtgggtccagtgagattgggcctgggcgctggagctgctgtggctcccgccgcggcggctgccatggaggccatgccagagcccagaactcacgccgggggaggccgagacagccggcggtactcatagatgaggcagcggcggcggcggcggcggcggcagcccgggctctccatgagcaggcggcggcggcgacgggtgcggcggcaccggcagttttcggtccccagggaggatgaagacactgtttgaagagatcaaagcatcaattaaaaataactataaccaagatcgatcattttgtaggcctgttcttccttgggggggtgtttttactatcaaagctggccgcaaagcagtatcctgtacaccactctatgttgaaataagactgaaaaatacctgcaccatagatggattcttgatgttattatatgtcattcttaatgaaaatgaaaacttccctagggaactctctcttcattttggtagagagtttgtagactgttttctttacttaatggacacctacagttttacaactgtgaagctactttggatttgggacaagatggaaaaacagcaatacaaatctgaagtccataaagcttcattaataattgatttgtttgggaatgagcatgataattttacaaaaaatcttgaaaatctcatgtctaccattcaagagagttactgttccaactggcgatgcccaactcgagtgcaggaggatcagcagcgcacaattaatataaatcctccccaagaaattccacatggaaacttgataagactggctgtgaatgagttattctgttccaagattgaactgtgtgaagagcatgggtgtggtggcttaagagaattttcccaacgaattttctgccatggggcacccccttttgttgtcttaaatatgcaacattggaaatctgaagatctggcgtatgtaccctattacttggatttgtctgatcacaagtatttgttggaaggtgccacattatttaacaaagaggaacatcattattctgcagctttccagattggtggacattggatgcactatgatgggctcagaaatgtgaatttaattttgttaaataaacccccagagtttctcctcttgtcatcattggtttatattcgagcaacagagaaataaatatagattgatgctaaaagttgttttccctcctgcccatgctctcccagatgaagggcttttattttgtgtatacttggtatccaagaaaatagttcaactatactagtttcagaagtgtattttcagtgtttaaccccaggtaaatgttttatatagaggatctgtgcaaaaatgtttgtaatttttttatatttcctgagttatttttatatgagcatattttatgttggaataaaatatatcttgtggcctttgtattttttatttatatgtacctcaaagatttttacaattctgtctttgaattcaagaaatactttgtcatctgaattctaaatttttctttttggatattcgagtaaaacctaggtaaaagtattttaagtttatataatttaacagttcaaaatatatctgactgtatttctttgccctacctcactataatccaaagtgcactatttgatctagtatggatttgaatgtacaatttatcgatggcttagtttattagttcgatttgcctagtatccctgcagcaattttttaaaatgtctgagaaatttttcagagcttaaactatttctttataatggcaaattacttttaactacttcctaaagtattataaacctgccagtggattttaagtgatagctaagcttccaagcttaattcacgttattacaaataaattatataactatcttaaatgtttatcttataattaaatgtaatttgaaatgctctaatgtattttgcagataaaacaactataaacaatattaggcaactggatgtttactagtgtcggactagcaatagaaatgcactttaaatatatatttaaggggaaatgcgtgcctggaaatacttcttttcctagtgaagttttatattgacacagagaaaagaatacttaaaattttgagtgatgtctactggcttccttgtaagtagtgattgatagcatgcggctttgacttgcaatacaaatcattacgattttatagttatcagaacattacgtttctttataaagaccctaaggtcactcttctttttgcaacttaagggaaaaaatattctcaagggaaaatactttttgaaatttatcaccattttagtgtttacatttcaataaatagttcacttcaggtttgggattgagattagttgcaatatatttagaagctcctacatgacagcacagatcactgccatctgctgaactgctaaagtgcttggtgccatgttgagaaaacttacccaagaatggataaatatgggtgaaacattactgagaatgcctcacgttagcaaatactatgaaaattcttgtttatatatcaaactgatttattttacaaaaaaaaaaaattcaccccaagatttatttagtttcccaagtgtatctgattaggatttaatttagagtaaacttttctggggacacctgattgcatgaactgaagtatacaataacacaaatattacagtaaacataaatggtgtcattaacaaaattattcctaatgcagatttattctttcaggaaatgcactttatttggaatactagtttatcatgaaacaatgacttacctacctcacagggttgttgtgaggattaagatgtttgttaaaatcttgactaccttgaacatgctaataaaaaaacatttttctacctcttttatttgca

SEQ ID NO: 118302 - DNA, 1097 bp, Homo sapiens
  Payload ID: 3152
  Gene Symbol: C14orf28
  Gene Name: chromosome 14 open reading frame 28
  ENST ID: ENST00000557112
  CDS Start-End: 236-1078
gtgggtccagtgagattgggcctgggcgctggagctgctgtggctcccgccgcggcggctgccatggaggccatgccagagcccagaactcacgccgggggaggccgagacagccggcggtactcatagatgaggcagcggcggcggcggcggcggcggcagcccgggctctccatgagcaggcggcggcggcgacgggtgcggcggcaccggcagttttcggtccccagggaggatgaagacactgtttgaagagatcaaagcatcaattaaaaataactataaccaagatcgatcattttgtaggcctgttcttccttgggggggtgtttttactatcaaagctggccgcaaagcagtatcctgtacaccactctatgttgaaataagactgaaaaatacctgcaccatagatggattcttgatgttattatatgtcattcttaatgaaaatgaaaacttccctagggaactctctcttcattttggtagagagtttgtagactgttttctttacttaatggacacctacagttttacaactgtgaagctactttggatttgggacaagatggaaaaacagcaatacaaatctgaagtccataaagcttcattaataattgatttgtttgggaatgagcatgataattttacaaaaaatcttgaaaatctcatgtctaccattcaagagagttactgttccaactggcgatgcccaactcgagtgcaggaggatcagcagcgcacaattaatataaagtgtggtggcttaagagaattttcccaacgaattttctgccatggggcacccccttttgttgtcttaaatatgcaacattggaaatctgaagatctggcgtatgtaccctattacttggatttgtctgatcacaagtatttgttggaaggtgccacattatttaacaaagaggaacatcattattctgcagctttccagattggtggacattggatgcactatgatgggctcagaaatgtgaatttaattttgttaaataaacccccagagtttctcctcttgtcatcattggtttatattcgagcaacagagaaataaatatagattgatgctaaaa

SEQ ID NO: 118303 - DNA, 6495 bp, Homo sapiens
  Payload ID: 3153
  Gene Symbol: C14orf37
  Gene Name: chromosome 14 open reading frame 37
  Uniprot ID: Q86TY3
  ENST ID: ENST00000267485
  CDS Start-End: 196-2520
ctccccctagcgtcccagacagcggagggagtcgccgccgctaccgccgccgccgccgcagggcccgccgctgggatgccgagcgcccgcgccgccgctgcctctgtcctccgcgcgctgctcagctgaaggcgcacaggattcaattactggacttgtcaactctgccagtgtacgtgccatttctcttccactatgagaggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagggacaagaagatgaggatgaagaggatgaagaagatgaagatgaagaagaggaagatgaggaagaagatgaggaagataaagatgcagactcgctggatgagggcttggatggtgacactgagctgccaggttttaccctccctggtatcacatcccaggaaccaggcttagaggagggaaacatggacctgttggagggagctacctaccaggtgccagatgccctcgagtgggaacagcagaatcaaggcctggtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttgaattggactgggttttaattgggatattcaacgatgctactattctaatttttattttggagcagaaaaaaaaaaagaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaagaagctctctcagcatattaggattatatgtagatttgtatgtattttgcattatgtacttcagtctcctagttttattattctcaccttccgttttattcttggcgaggaaaaaaatgcactagaaataatacattaaactgactcttagtcttaatgtacgtttgctgtcttaaatagtgtgattgagtccaacagactcaatcatacatgtcatacatgtttatgattaagagatattctttttgtgtgctagttgattttgccgagaaaaaatgaagaagaattcaagaatgagatgagggtaggtaagctctcagagcatttctgtctgccatttggttctatgcttatgtggctgctaatgtgactaattcagagtgttgtatttccacatctgtggactccaccatggaaaaggtgggctaccattggtccttatatggctttattagaaaaatagacattctatcgtttgtctgcccagtggccagagtcctggtgaacaacagagctcatgggaaaccagcctctctcagggcaccccgctatgaggatattgaaatatgttcaatcatttctcatctcccttggaatgtaattccctgccctatacaaaataggatattccaatgcgctatttgaatctagggattgaggatttgtagttgagttttggggtaaaggcttggctcattgccatggaagaataaaagttatttattaatagtgctgtcactgtggagtacttgttggtgtttattagaagttgtctactatgttcaagaaaagttgcacagttattcctcagagctactatgtgaggtaggacatatgtttttattctcccatttgactgaagatggaactgaagcagagaagtgaaatgattttccaaagttgtacccagagagaatcagcgtgagaacccacttggacccagccatgcacccttatcttcagttcagtaaccttttcatagactttggtggaagcagtgacatttcagggtccttctttaaaacaaaggttctaagggaatagcagggaatagctgcctggtcaaggaacgtttgatgtgaatttccatctttgttaaatgaatgatgcctttctaatttctctcttactcacacacaagttctttccttccccatctcagttatcagttatttcctttacagtcatacatttgagtatcacctctatggaactaataaaccttcctagaatccgtttttgaataatgtctggctcacaagaacattttcatcaaataattttaactctttttgccaagagatgtaagcaaatatgtgaaactgatcaagagaagtgaaaagctctgtacagtcaaatagaagttagcaactggcaaattagctcaaggtcagattttaaaaatagaattcagaatcatgacactcagaagtgatttgtaatttcacgagtagagacatcctgatattgcataagggatgttttccttttctaagagcagccctttgctgtaagtgtttctaaggttgggagtaagtgagcatggtgtggcattactgtctttgtattcttgacaaactatttgttgagaatacgtcgtaggccacttaactgagtagcacatgggtgatactagtggccattattgccttgggctactcaatctatagtcttaactaaaccatggctaataggttgaatcttcaaactgtagtgtaataaattcccaaataacagacccatattttcatttctcagaggtccgtgaggatgacatgtatgtgaattttggcttaacacagtatctctgtggtcctttttgggacacatgatttcttaaaggaaaagattatacttagagtacatttctgtacaaacccatttaaacatctggattgagtggaaggtcggtggatggtacaaatgacatgtttattttggccattttccttgctgctggtggctgtggaataatgattttcagtggttggcttagattattaagaggatcagaaaaggttgtcatattttaaacaaaacctgggattagagatgctgctacgagatggaagtgctggccagtggttatatagtggtccagttgagaagtagtaaatcaggcacttgtaggtttacccaaaataagtgacaagtatgcttatatttgcacaattaaaatagaaagtcaactttttattcaaacaactaggcttaaaacatttaacagtgaaacaaataaagctgtctggaaaggagggctgattcctgcagcttcagttgtgaacaccatccccactggactgagtttacccagccagaactgccagcatcccaccgcaggggcaggaactaggtcttcttctcggagggagaggcagtgtttccagaatttgcaggctcataaaaatcacctgggacacttgtgaaacatacagatctcaaggccttgccccagacctgatgagttagaatctccagggaaggagcttggggtattcatgccccagcaagcttgggaacacagctaggagggatctatctagagaaccacttccttatgatagagacaaggtcatttaaagtcacaatgagataccacctcacacctattgggatggctattattcaataaaacaaaatataacaattgtttctgaggatgtggagaaattggaatccttgtatactgtgggtgggaatgtaaaatggatagccactgtggaaaacagtatgaagattcctcaaaaaattaagatagaactactatataatccaactatcccacttctgggcatatatccaaaagaatagaaatcaggatcttgaagaagtatctgtacgcctgtgttcattgcttatgcttataagcatattattcacaataagcttataagtattattcacaatagccaagatatggaaattgcattgatagatatgcaaatatctatcaatagatgaatggataaagaaaatgtggtatatacatacagtagaatattattcagccataggaaataaggaaattctgtcattgtgacaatatggatatacatggagaacattatgctaagtgaaataaactagtgacagaaggacaaatgcatgattgcacttctttgaggtatccaaaataatcaaactcataagggcagaggcaaaatggtgcttgccacgggctgggcaaagttaaaggtggggagatgttgattaattatgtttcagttatgcaagatgaataagttctagagctctgctgtataacatagtgcctatagttaacaatatcgtactgtgcagttaaaaatttgttaagagggccgggtgtggtggctcacgcctgtaatcccagcactttgggaggccaaggtgggcagatcatgaggtcaggagatagaaaccatcctggctaacatggtgaaaccccatctctactaaaaatacaaaaaa

SEQ ID NO: 118304 - DNA, 557 bp, Homo sapiens
  Payload ID: 3153
  Gene Symbol: C14orf37
  Gene Name: chromosome 14 open reading frame 37
  ENST ID: ENST00000555101
  CDS Start-End: 1-293
cagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaaggtattcatgctttgaaggggatcttttcaaggactggttgagtgagtcactgagcaaatgtttttgaaaaagaattaagtaggagtatattcaatctgcagtatagatcagaggacagtaaactacagctgggccaaatctggcctgccacttgtttttgaatggtttgtaagctaagaatggtttttacattttgaaatgattgaaaaaaaaagtcaaaagaagaataatattttgtgacatagaaaagttataaaaattcaaattccagtgttcataaataaagctatattggaacacagcca

SEQ ID NO: 118305 - DNA, 2813 bp, Homo sapiens
  Payload ID: 3154
  Gene Symbol: C14orf39
  Gene Name: chromosome 14 open reading frame 39
  Uniprot ID: Q8N1H7
  ENST ID: ENST00000321731
  CDS Start-End: 161-1924
gctggtaccaggggcgtgggggcggggctgagcgagtccagcccagggctccggggaccgtttgtagttaggatccgctgtggcgtcctgagtggagtttgggaccccagggagggagggtgtgggcgttcgggtccagaggagctgtttagtatccaagatgaatgacagcctgtttgtcagtttggacagacttttgctagaatttgtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaacatgaagattatatgcaggaccaatttactgtttatcaaggaactgttgaaaaagacaaagaaatgtatcatgattatatatgtcagtataaagaagttttgaagcagtaccaactaaaatactcagaaacacccttttcacgtgaatattatgagaagaaaagagaacatgaagaaattcaaagcagagtgttggcatgtactgaacaattaaaaatgaatgaaacaatttttatgaaatttcgagtgcctgctccctttccatcacttactaaatggactttaaacattgttaatttgagatgtgaaacacaagatattcttaaacatgccagcaatcttaccaaaagttcatccgaattgaagaaagaagtagatgaaatggaaatagaaattaattatttaaaccagcagatatctaggcataatgaaactaaggctctttcagaaactctggaagaaaagaacaaaaatacagaaaacagaaaagaactgaaagaaagaatttttggaaaagatgagcatgtacttacattgaataaaactcaaagcagtcaattatttcttccttatgaatctcagaaattagtaagaccaataaagatgcattcttcagaaccaagagttgcagatataaaagaagaaagttctgcgaagcagtcaaagcttgccaatattgactttagacaaaaagaaaatgatacacagatatttaatgactctgctgtggataaccattcaaaatgttcacatattacgactatcacaagttcacaaaagtttatgcaagtcagattgttaaccccacagaaacaatcaaattccaatcagtggtcggaaaaaggggataaagatgctgagtatggagataaagggacagtaagacaagtaagagaatcaaaatgtacttcacaagctatatatactgaacattttgggaagtcagtagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaattaacagaaatagaaatgcagtacctgaagttcaaacagaaaaggaatcccctggactttcttttcttatgagttatacttctagatcacctggattgaatttatttgattcttctgtatttgatacagaaatctcatcagatcagtttaatgaacattattctgcaagaaatctaaatcctctgtcatcagagcaagagattggaaacttacttgagaagccagaaggagaagatggctttacattttcttttccatcagacacttcaactcatacatttggagctggaaaagatgattttagttttccattttcatttggacagggtcaaaattcaataccttcttcttctttaaaaggtttttcatcttcctcacaaaatacaacacagtttacttttttttgagctagtcattaattccttaaattattttactgttctgtgttcatgagggcataaatttacattattgcttaaaacatgaagactgctttcttttattgattaaagcagtaatgtttacattatttgattatatttattgaaatattgaaatactgaatattttgggttttgtgtgtgctattaactaatcattatttattttggttttgattttgcgagccgtggtcaggtagaacttttattaatcttaatagaatttgatgcttttttcattactctttatttaaatattaagcctgcttctccttggaacctaaggtttttttctggaagtattgttggtactttgataagaacaagaactgcagtagtaactccagagttagtgctgaagcgtactttagctactaaaaatttctattaaaattattgggtttcacttctgcttcactatgtagtatacagagtggtactgtaataataatttcaaataatttatgttaataacaaaatctgtgttattttcttctaatataacacatggtacaattctaattttatgagttatgctaatgctttcaatggctaaaaattaaatgtaaagggcaagagtaatttctgaaaattggattgttgtatcagtggtgatcctgttaatattcttttttgcttaaatattttttgaagaacatttacaattttgtctccttcaataacaaaaatttcttctttatgttttgtgttcagtatttgtcaattaattatatagcttaagtgaagatatttaagatttgatgaacttctgtaaacattttgctcaatatcattgtattttgtgctttgtaaattagctgtactgagttaccaagtaataaagggtttgactcca

SEQ ID NO: 118306 - DNA, 1497 bp, Homo sapiens
  Payload ID: 3154
  Gene Symbol: C14orf39
  Gene Name: chromosome 14 open reading frame 39
  ENST ID: ENST00000557138
  CDS Start-End: 84-197
ctgtggcgtcctgagtggagtttgggaccccagggagggagggtgtgggcgttcgggtccagaggagctgtttagtatccaagatgaatgacagcctgtttgtcagtttggacagacttttgctagaatttgtcttccagtatgagcaagacataagtactaaagaagagatgattcaaagaattaataatatctaggcataatgaaactaaggctctttcagaaactctggaagaaaagaacaaaaatacagaaaacagaaaagaactgaaagaaagaatttttggaaaagatgagcatgtacttacattgaataaaactcaaagcagtcaattatttcttccttatgaatctcagaaattagtaagaccaataaagatgcattcttcagaaccaagagttgcagatataaaagaagaaagttctgcgaagcagtcaaagcttgccaatattgactttagacaaaaagaaaatgatacacagatatttaatgactctgctgtggataaccattcaaaatgttcacatattacgactatcacaagttcacaaaagtttatgcaagtcagattgttaaccccacagaaacaatcaaattccaatcagtggtcggaaaaaggggataaagatgctgagtatggagataaagggacagtaagacaagtaagagaatcaaaatgtacttcacaagctatatatactgaacattttgggaagtcagtagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaattaacagaaatagaaatgcagtacctgaagttcaaacagaaaaggaatcccctggactttcttttcttatgagttatacttctagatcacctggattgaatttatttgattcttctgtatttgatacagaaatctcatcagatcagtttaatgaacattattctgcaagaaatctaaatcctctgtcatcagagcaagagattggaaacttacttgagaagccagaaggagaagatggctttacattttcttttccatcagacacttcaactcatacatttggagctggaaaagatgattttagttttccattttcatttggacagggtcaaaattcaataccttcttcttctttaaaaggtttttcatcttcctcacaaaatacaacacagtttacttttttttgagctagtcattaattccttaaattattttactgttctgtgttcatgagggcataaatttacattattgcttaaaacatgaagactgctttcttttattgattaaagcagtaatgtttacattatttgattatatttattgaaatattgaaatactgaatattttgggttttgtgtgtgctattaactaatcattatttattttggttttgattttgcgagccg

SEQ ID NO: 118307 - DNA, 558 bp, Homo sapiens
  Payload ID: 3154
  Gene Symbol: C14orf39
  Gene Name: chromosome 14 open reading frame 39
  ENST ID: ENST00000556799
  CDS Start-End: 293-558
attctcccacctaggtttaaattgaaccccgtctcggtcccccggttttgagaggtttctctcctcgagccgctgagtcacgcagcccaacagtaggagtggctcgaggcctacacgtccgcgagttcgcggggcgctggatggaaaagatttgaaacgccacctgtatcacatactaaatttatatacatagaaattattctggatcttctattctgtttcatcgatatgtgtatttattcctattgtttcacaactgcagttgaagtacattttaatatctgtatccaagatgaatgacagcctgtttgtcagtttggacagacttttgctagaatttgtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaaca

SEQ ID NO: 118308 - DNA, 482 bp, Homo sapiens
  Payload ID: 3154
  Gene Symbol: C14orf39
  Gene Name: chromosome 14 open reading frame 39
  ENST ID: ENST00000555476
  CDS Start-End: 139-482
ggggaccgtttgtagttaggatccgctgtggcgtcctgagtggagtttgggaccccagggagggagggtgtgggcgttcgggtccagaggagctgtttagtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaacatgaagattatatgcaggaccaatttactgtttatcaaggaactgttgaaaaagacaaagaaatgtatcatgattatatatgtcagtataaagaagttttgaagcagtaccaactaaaatactcagaaacacccttttcacgtgaatattatgagaagaaaagaga

SEQ ID NO: 118309 - DNA, 475 bp, Homo sapiens
  Payload ID: 3154
  Gene Symbol: C14orf39
  Gene Name: chromosome 14 open reading frame 39
  ENST ID: ENST00000498565
  CDS Start-End: 1-218
tgaatttatttgattcttctgtatttgatacagaaatctcatcagatcagtttaatgaacattattctgcaagaaatctaaatcctctgtcatcagagcaagagattgaaaagaccaagtgttttcggaatgaggggaaaaaaggtcatcatgagctagaaaacctgggaaggattcaccgaagaggtaaaattgaattaggactttacagtttgtgaatgctctcgtccccatcctcatccatggcgaaatcttcgcccccagcctcgtgaagatctagcacgtccgccatctcgccttcgatcgagatctcgtctgtgccgctcagacactagatactcaacatatactatatgctaggccatgcaagatgtagagaataccagaataagaaaataaaaattgatttctacatgatacattaagtgcaagaaatatccctctggcaaattaaagaaagtaaaggtatagtgaa

SEQ ID NO: 118310 - DNA, 1962 bp, Homo sapiens
  Payload ID: 3155
  Gene Symbol: C14orf79
  Gene Name: chromosome 14 open reading frame 79
  ENST ID: ENST00000389964
  CDS Start-End: 154-747
gtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgggacacactttcaactgagcattgaaagacagacagcgctcgagtggattaggccgcagtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggat

SEQ ID NO: 118311 - DNA, 790 bp, Homo sapiens
  Payload ID: 3155
  Gene Symbol: C14orf79
  Gene Name: chromosome 14 open reading frame 79
  ENST ID: ENST00000551606
  CDS Start-End: 1-659
gcacgccgttgccaggcaacggggcggcgcaggcaggagggaacggctggttgcaggtttctctcgccctggtcccgcgcggccccgccgaggcggcgaccaagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacagga

SEQ ID NO: 118312 - DNA, 1645 bp, Homo sapiens
  Payload ID: 3155
  Gene Symbol: C14orf79
  Gene Name: chromosome 14 open reading frame 79
  ENST ID: ENST00000548641
  CDS Start-End: 97-654
aggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgttaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcct

SEQ ID NO: 118313 - DNA, 1912 bp, Homo sapiens
  Payload ID: 3155
  Gene Symbol: C14orf79
  Gene Name: chromosome 14 open reading frame 79
  ENST ID: ENST00000550614
  CDS Start-End: 902-1153
attttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataagc

SEQ ID NO: 118314 - DNA, 2370 bp, Homo sapiens
  Payload ID: 3155
  Gene Symbol: C14orf79
  Gene Name: chromosome 14 open reading frame 79
  Uniprot ID: Q96F83
  ENST ID: ENST00000547315
  CDS Start-End: 640-1617
acggggcggcgcaggcaggagggaacggctggttgcaggtttctctcgccctggtcccgcgcggccccgccgaggcggcgaccaaggtgggtgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctgg

SEQ ID NO: 118315 - DNA, 2503 bp, Homo sapiens
  Payload ID: 3155
  Gene Symbol: C14orf79
  Gene Name: chromosome 14 open reading frame 79
  ENST ID: ENST00000549240
  CDS Start-End: 1809-2060
ttgtgtctctgagcaggcctggactttcagagagctctgcagacaggccattctgggctccagccctggcccaccgtgtcctctgctggggtccaaccagcacctgccccagggtaccctctacaggggcttgaggacagaggcctggagcccagaaggccgcaaccagcattgcccagatggcccgtgtgccctctgtgtgtggtgcttctgcaaagcatgatccctggggaaaaactgtggagaatgtggtcccagcaagctgacggtgggggtgggctctgtgctggcagcattgacatctctgtccccagcagcacaactcgcggacccagaggcatggggagtcctgggtgtcaggacttggcggggctggacactcgtgggacagaaggctggatggtactttgggggtggagtagagcatggtttgtgtgttctgaaacactggggtatttttggaaatggtttggtgtttagcacatttgctcttcttctgtactcatctggagtgcagtggcaccatctcagctcactacagcctccgtctcctaggcttaagcgatcttcctgcctcagcctcctgagtactgggactacaggcacccgccactacacccagctaatttttgtattttttgtagagacagggttttgctatgttgctcaggctggtctcaaactcctgagctcaagtgatttgccctcctcagtctcccaaagtgctgggtttacaggtgtgagctgccgcacctgcccttgcactcattttcccttccatactagaacgtgaacttcctgcaggcagaccttctcagtccctcacagtgcgtagcagtgacgtgtggcacatagtagacattcaccgttggtttgctcatttgttctcctgagcatgcactggtactcgtagtttgggagcatctgttttgtactcagcacagttctaggcacttgagtgaacaaaaccagcaaaatatctggtctcacggagcttccactccttggaggagacagtaacggcagtaagtcagctactccagggcaggtgctgtgaggcatagagggggcacgggaggtgggttggggtgttgaaggatggcacgtgttgtttgaataaaagtataaatgaacaaataaatgagacagcccagtgctcctgcagggaatgctgtttttatttgtttttttgtttgtttgtttgagacagagtctcactctgtcccccaggctggagtgcagtggcgcgatctccgctccctgcaacctccgcctcccgggttcaagcgattctcctgcctcagcctccccagtagctgggatgacaggcgcccatcaccacgcccggctatttttttgtatttttagtagagacggggtttcactatgttggccaggcagatcttgaactcctgacctcctgatctgtcagcctcagcctcccaaagtgctgggattacaggcgtgagccactgtgcccagcccgggaacactgtttttagagttcttaacagccatacgcctcttggcttgtgcgcgtctcggcttgcgggtaaaggccaggcgccccgctgcgtgcctcgggccgtgcctcatgatctcctcagaaggctctcaaggtcaccttttaacaagtgcatctgttttccagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaa

SEQ ID NO: 118316 - DNA, 1947 bp, Homo sapiens
  Payload ID: 3156
  Gene Symbol: C14orf80
  Gene Name: chromosome 14 open reading frame 80
  Uniprot ID: Q86SX3
  ENST ID: ENST00000329886
  CDS Start-End: 254-1318
gggagagcgctgaacaaggccgcagagctgctccgccatctcccccacgcctcctgccaagttctgtggcgccgcggttccccacctcctgctcccatccccctggctcccgccgccctgtagctcggcagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacagacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacag

SEQ ID NO: 118317 - DNA, 1358 bp, Homo sapiens
  Payload ID: 3156
  Gene Symbol: C14orf80
  Gene Name: chromosome 14 open reading frame 80
  Uniprot ID: Q86SX3
  ENST ID: ENST00000334656
  CDS Start-End: 330-1076
gctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgc

SEQ ID NO: 118318 - DNA, 1553 bp, Homo sapiens
  Payload ID: 3156
  Gene Symbol: C14orf80
  Gene Name: chromosome 14 open reading frame 80
  Uniprot ID: Q86SX3
  ENST ID: ENST00000354560
  CDS Start-End: 109-1290
tgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataa

SEQ ID NO: 118319 - DNA, 1630 bp, Homo sapiens
  Payload ID: 3156
  Gene Symbol: C14orf80
  Gene Name: chromosome 14 open reading frame 80
  Uniprot ID: Q86SX3
  ENST ID: ENST00000392522
  CDS Start-End: 128-1408
ttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgt

SEQ ID NO: 118320 - DNA, 1845 bp, Homo sapiens
  Payload ID: 3156
  Gene Symbol: C14orf80
  Gene Name: chromosome 14 open reading frame 80
  Uniprot ID: Q86SX3
  ENST ID: ENST00000392523
  CDS Start-End: 122-1609
ccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcgctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcct

SEQ ID NO: 118321 - DNA, 1476 bp, Homo sapiens
  Payload ID: 3156
  Gene Symbol: C14orf80
  Gene Name: chromosome 14 open reading frame 80
  Uniprot ID: Q86SX3
  ENST ID: ENST00000392527
  CDS Start-End: 178-1236
gccgggagggccgcctggaagaggaggtcgggggcgaaggaggccgagaagaaagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtg

SEQ ID NO: 118322 - DNA, 543 bp, Homo sapiens
  Payload ID: 3156
  Gene Symbol: C14orf80
  Gene Name: chromosome 14 open reading frame 80
  ENST ID: ENST00000427614
  CDS Start-End: 304-543
gctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcgggccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgagga

SEQ ID NO: 118323 - DNA, 1107 bp, Homo sapiens
  Payload ID: 3156
  Gene Symbol: C14orf80
  Gene Name: chromosome 14 open reading frame 80
  Uniprot ID: Q86SX3
  ENST ID: ENST00000450383
  CDS Start-End: 361-1107
cgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctga

SEQ ID NO: 118324 - DNA, 966 bp, Homo sapiens
  Payload ID: 3156
  Gene Symbol: C14orf80
  Gene Name: chromosome 14 open reading frame 80
  ENST ID: ENST00000443229
  CDS Start-End: 636-966
gtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcc

SEQ ID NO: 118325 - DNA, 880 bp, Homo sapiens
  Payload ID: 3156
  Gene Symbol: C14orf80
  Gene Name: chromosome 14 open reading frame 80
  ENST ID: ENST00000455454
  CDS Start-End: 233-880
gcagagctgctccgccatctcccccacgcctcctgccaagttctgtggcgccgcggttccccacctcctgctcccatccccctggctcccgccgccctgtagctcggcagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatg

SEQ ID NO: 118326 - DNA, 751 bp, Homo sapiens
  Payload ID: 3156
  Gene Symbol: C14orf80
  Gene Name: chromosome 14 open reading frame 80
  ENST ID: ENST00000421892
  CDS Start-End: 281-751
cacgaaggcgggaccctgccgacgcagtgattggatgcatgtccggccagcgcggtgattgggtacaggtctcgggagcgcggtgattggacctccgcgctctggcagctcctcttccgtgtgctctcgccactccctgcgggcaacgccttggcatcgctcgccctggggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgag

SEQ ID NO: 118327 - DNA, 1144 bp, Homo sapiens
  Payload ID: 3156
  Gene Symbol: C14orf80
  Gene Name: chromosome 14 open reading frame 80
  ENST ID: ENST00000432805
  CDS Start-End: 237-1144
acggagggcgtgcggggagggagaggaggggcttgctggggggggggccccgaggcggggccgggagggccgcctggaagaggaggtcgggggcgaaggaggccgagaagaaagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagc

SEQ ID NO: 118328 - DNA, 522 bp, Homo sapiens
  Payload ID: 3156
  Gene Symbol: C14orf80
  Gene Name: chromosome 14 open reading frame 80
  ENST ID: ENST00000451719
  CDS Start-End: 359-522
atgattgggctcaggttccagccggagcggtaactgggcgcaggtcccagccgccgcactaaacccggcccgtgcggtgattggacgcaggccccgggccgcggcggaggcgggcgatccgaaagagacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgcca

SEQ ID NO: 118329 - DNA, 1358 bp, Homo sapiens; identical to SEQ ID NO: 118317
  Payload ID: 3156
  Gene Symbol: C14orf80
  Gene Name: chromosome 14 open reading frame 80
  ENST ID: ENST00000548920
  CDS Start-End: 10-369

SEQ ID NO: 118330 - DNA, 3354 bp, Homo sapiens
  Payload ID: 3157
  Gene Symbol: C14orf93
  Gene Name: chromosome 14 open reading frame 93
  Uniprot ID: Q9H972
  ENST ID: ENST00000299088
  CDS Start-End: 431-2047
gagtcctcctttttgcacacacacgaatacaaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcaaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacatatgccctgtctctgagttgtttctgcccctgcccagttccacccaaagctctgaggaagcagcccaggttgtaccttttgcttccctgtgactacttgtcttgctctgcagtggaaaccgaacatgaccagtgcaggttaataccgccacctggtgggcagtttcagtcatgagcttgagtcttctgaccaagggaacacaagttctatcactattggggaattgggttcctgatataatagctattgtttattgaattacatgaggaaaattttactattcctatcttacagatgaggaaattaaggcttaaagagttcccgtgtctcaccggcagcctctctctcactatgtgaccaagcaaaatacacagctttgtagctgtttcttggtcctgtcagccaagctgtattttgaggaaggggtgtgcattttggatggattgaaaagcaaaaatggctttacatttattcagtcttataacaaacattgatcgctttactaggtgtcaggtactgtgctatggatacattgttgataaggttggatgctgttcagagatttttttagtttagtcaggaagccaggcagtggagtaggcaatgaaatgaactgtgataagggtgaccatggtggagtgtagtgcactatggcaatatacagcaggggtagctaacctactcttgcagtctggaaaggcttcttctgagagggtgtaatgtctaaactggggaagagttaaccagaaggaaaggggaggctaagagagtgttccaaacagggaactgcaggtacaaaagtccaggggcaagagagagtacagacaaggtccagttctactgcagacttttggggaagggataatgctagaggagaggctggagagtgagacagacctcataatacagagtacagacttcaacccaagggcagtgagaaatcattgaaagtttgttttagcagggaaataaaacgacaggttttgcctacaggc

SEQ ID NO: 118331 - DNA, 2221 bp, Homo sapiens
  Payload ID: 3157
  Gene Symbol: C14orf93
  Gene Name: chromosome 14 open reading frame 93
  Uniprot ID: Q9H972
  ENST ID: ENST00000341470
  CDS Start-End: 412-1908
cacacgaatacaaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcaaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacat

SEQ ID NO: 118332 - DNA, 861 bp, Homo sapiens
  Payload ID: 3157
  Gene Symbol: C14orf93
  Gene Name: chromosome 14 open reading frame 93
  ENST ID: ENST00000397376
  CDS Start-End: 484-861
ctttttgcacacacacgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctct

SEQ ID NO: 118333 - DNA, 1776 bp, Homo sapiens
  Payload ID: 3157
  Gene Symbol: C14orf93
  Gene Name: chromosome 14 open reading frame 93
  ENST ID: ENST00000397377
  CDS Start-End: 630-1706
caaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggctt

SEQ ID NO: 118334 - DNA, 1949 bp, Homo sapiens
  Payload ID: 3157
  Gene Symbol: C14orf93
  Gene Name: chromosome 14 open reading frame 93
  Uniprot ID: Q9H972
  ENST ID: ENST00000397379
  CDS Start-End: 241-1857
cgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctg

SEQ ID NO: 118335 - DNA, 899 bp, Homo sapiens
  Payload ID: 3157
  Gene Symbol: C14orf93
  Gene Name: chromosome 14 open reading frame 93
  ENST ID: ENST00000397380
  CDS Start-End: 274-899
accaacctgggcaacatagcaagaccccgcctcttaaaaaaaaaaagattaaggaatcaggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgaggg

SEQ ID NO: 118336 - DNA, 1986 bp, Homo sapiens
  Payload ID: 3157
  Gene Symbol: C14orf93
  Gene Name: chromosome 14 open reading frame 93
  Uniprot ID: Q9H972
  ENST ID: ENST00000397382
  CDS Start-End: 284-1900
cggctcgggctccgcgagtcctcctttttgcacacacacgaatacaaagagccatacgaccttcgggtatcctttttccattttttttcctccttaatcttgtgtgtgttttcaaattttttaaaaatagagatctgtagcagtgttgggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagat

SEQ ID NO: 118337 - DNA, 852 bp, Homo sapiens
  Payload ID: 3157
  Gene Symbol: C14orf93
  Gene Name: chromosome 14 open reading frame 93
  ENST ID: ENST00000553675
  CDS Start-End: 256-852
ctttttgcacacacacgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcct

SEQ ID NO: 118338 - DNA, 618 bp, Homo sapiens
  Payload ID: 3157
  Gene Symbol: C14orf93
  Gene Name: chromosome 14 open reading frame 93
  ENST ID: ENST00000555098
  CDS Start-End: 383-618
ctttttgcacacacacgaatacaaagagccatacgaccttcgggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgc

SEQ ID NO: 118339 - DNA, 568 bp, Homo sapiens
  Payload ID: 3157
  Gene Symbol: C14orf93
  Gene Name: chromosome 14 open reading frame 93
  ENST ID: ENST00000555575
  CDS Start-End: 250-568
ctttttgcacacacacgaatacaaagagccatacgaccttcgggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtcca

SEQ ID NO: 118340 - DNA, 467 bp, Homo sapiens
  Payload ID: 3157
  Gene Symbol: C14orf93
  Gene Name: chromosome 14 open reading frame 93
  ENST ID: ENST00000553606
  CDS Start-End: 440-467
ctttttgcacacacacgaatacaaagagccatacgaccttcggttttaatttggtttaacctttagtttcaggtttagctgtgcctcccagtgactataatgacaaggaagctgtaaatgtatttgagttaagcttttgcgagaagcaaagtgacagcatagctgttcaaacattcctgttgaattttggatccacccttaaggagcttgagaaatgaagataaggggccccacgggtgatttctctgggctcctggctggaagattcaggacagctagtttccattacagaggctcatggcccagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttct

SEQ ID NO: 118341 - DNA, 588 bp, Homo sapiens
  Payload ID: 3157
  Gene Symbol: C14orf93
  Gene Name: chromosome 14 open reading frame 93
  ENST ID: ENST00000553958
  CDS Start-End: 338-588
ctttttgcacacacacgaatacaaagagccatacgaccttcgggcaaagtgacagcatagctgttcaaacattcctgttgaattttggatccacccttaaggagcttgagaaatgaagataaggggccccacgggtgatttctctgggctcctggctggaagattcaggacagctagtttccattacagaggctcatggcccagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccag

SEQ ID NO: 118342 - DNA, 499 bp, Homo sapiens
  Payload ID: 3157
  Gene Symbol: C14orf93
  Gene Name: chromosome 14 open reading frame 93
  ENST ID: ENST00000556419
  CDS Start-End: 467-499
ctttttgcacacacacgaatacaaagagccatacgaccttcgggtatcctttttccattttttttcctccttaatcttgtgtgtgttttcaaattttttaaaaatagagatctgtagcagtgttggggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccct

SEQ ID NO: 118343 - DNA, 571 bp, Homo sapiens
  Payload ID: 3157
  Gene Symbol: C14orf93
  Gene Name: chromosome 14 open reading frame 93
  ENST ID: ENST00000555998
  CDS Start-End: 423-571
acacacgaatacaaagagccatacgaccttcggagactgggtcttgctatgctgccgaggttggtctcaaactcctgggctcaagcgatcctcctcctcccaaagtgctgggattacaggcatgagccaccatgcccagccatgaatgtcttactaccctatcagttaatcctatacattgctcaaggctcaactggaagcttttcttcttttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactgg

SEQ ID NO: 118344 - DNA, 585 bp, Homo sapiens
  Payload ID: 3157
  Gene Symbol: C14orf93
  Gene Name: chromosome 14 open reading frame 93
  ENST ID: ENST00000553931
  CDS Start-End: 177-585
ctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaagg

SEQ ID NO: 118345 - DNA, 441 bp, Homo sapiens
  Payload ID: 3157
  Gene Symbol: C14orf93
  Gene Name: chromosome 14 open reading frame 93
  ENST ID: ENST00000554179
  CDS Start-End: 414-441
gagtcctcctttttgcacacacacgaatacaaagagccatacgaccttcgggtatcctttttccattttttttcctccttaatcttgtgtgtgttttcaaattttttaaaaatagagatctgtagcagtgttgggaatgtcttactaccctatcagttaatcctatacattgctcaaggctcaactggaagcttttcttcttttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttct

SEQ ID NO: 118346 - DNA, 4517 bp, Homo sapiens
  Payload ID: 3158
  Gene Symbol: C15orf39
  Gene Name: chromosome 15 open reading frame 39
  Uniprot ID: Q6ZRI6
  ENST ID: ENST00000360639
  CDS Start-End: 321-3464
actcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 118347 - DNA, 4430 bp, Homo sapiens
  Payload ID: 3158
  Gene Symbol: C15orf39
  Gene Name: chromosome 15 open reading frame 39
  Uniprot ID: Q6ZRI6
  ENST ID: ENST00000394987
  CDS Start-End: 234-3377
accgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 118348 - DNA, 3152 bp, Homo sapiens
  Payload ID: 3158
  Gene Symbol: C15orf39
  Gene Name: chromosome 15 open reading frame 39
  ENST ID: ENST00000565074
  CDS Start-End: 1-2422
tgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgtgtgtgctgtgtgagtgcgtcacagctggggctgagtgattccaaggactcctgcccgggtagggggctttaggatgagctctaggtacccccaccccttgaccctccagacaatcagtgagcaccttcatagcctcttttgtaggcttctgaacatgccagctgctctgtccccatggaaactcctcggcctcccctggtgctgcaccttcttggattccctcctcctctgcctgtgccttctccatctttggtgcagtgtttccggcactctggttaggccctgttttctagctgagataatttccctgatctccagcctagcatcccctttgtgagctctagccctaaataacccactgcatgctgggcctcagcccctgggtctctctcccacactgaactcatcccaaatcacactcccgagccttcccctcagctcacttcccacaaccagttcttttccatgtcagtgaagggcaccccctttcacaaagctcctcatgctctagacctggtgagggccacagctgcctttttgaacgtgtagttttgcagtcctccccggcccttacatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgta

SEQ ID NO: 118349 - DNA, 581 bp, Homo sapiens
  Payload ID: 3158
  Gene Symbol: C15orf39
  Gene Name: chromosome 15 open reading frame 39
  ENST ID: ENST00000563905
  CDS Start-End: 518-581
aatgagggggcagcagccaaccacctggccagacccagccgcctcagccagccttagaaaggcttccacgatagtccacctggcctgcccacgctgccactcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttag

SEQ ID NO: 118350 - DNA, 353 bp, Homo sapiens
  Payload ID: 3158
  Gene Symbol: C15orf39
  Gene Name: chromosome 15 open reading frame 39
  ENST ID: ENST00000564848
  CDS Start-End: 273-353
ggcttctggctgccgccggccccccgcgaacgggctgcggggcaggggtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtcagaagttgagtagcaggggcctaggagggctcgaagccttcacagcgatggcagagaagcgacccctgagaaccctggggcctgtgatgtatggcaagctgccccgcttagagacagactccgggctc

SEQ ID NO: 118351 - DNA, 532 bp, Homo sapiens
  Payload ID: 3158
  Gene Symbol: C15orf39
  Gene Name: chromosome 15 open reading frame 39
  ENST ID: ENST00000562637
  CDS Start-End: 446-532
agaggcactttcactttccagctgccactcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcac

SEQ ID NO: 118352 - DNA, 4249 bp, Homo sapiens
  Payload ID: 3158
  Gene Symbol: C15orf39
  Gene Name: chromosome 15 open reading frame 39
  Uniprot ID: Q6ZRI6
  ENST ID: ENST00000567617
  CDS Start-End: 1-2817
atggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 118353 - DNA, 11244 bp, Homo sapiens
  Payload ID: 3159
  Gene Symbol: C15orf40
  Gene Name: chromosome 15 open reading frame 40
  Uniprot ID: Q8WUR7
  ENST ID: ENST00000304177
  CDS Start-End: 9-470
aggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcgaataagactccaaaaagtagaaatttaaaaagtgctatacattgcatcaggttctaaaatcccaaaccccaaacagcctggaacatgttactctgatttcatggcgttgtaaaataacagagctgggaagaatattcaagatgacctgatttaacacctttcattctgttggggggcctttgatttcctatatccagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaattttttttttacatcttttaaagactatatttaccattttgttgaaaaagtaaagaaaaatcatgacttgtaattaaatgtgaattataatttttgagaagtcactgaattttcatcttcctctaataacttaaataatcagcaaattcagtagtttttatgaatctccaaagatccttaaaagaagaaagaggacttggaagctattttcagtatttgtaaaagcttgtcagaaattacatctatattaaagtttcaaaagctaataatatatttttacatcttcaggtcaagttatagtaatttattaaagaaaataaaattaatttcctttgctgatcaggagagctgatctgcagttgtgcgctttgtccagcaagtacatgagaaagatgtattgatggaccaaatcattaaaaacaaaatccacaaggaagaacaataataaaaattgctgatggtagctgggcttggtggctcacgcctgtaatcccagcgctttggaaggttgaggcaggaggaacacttgagcccaggagtttgagaccagcctgggcaacgaagtgagaccctgtatctgtctctgtctctttctttatagatagatagatatacatagatagattttatacatagatatatatatttatatgtaagattatatataagacctcatatataagaagtccaggccgggtgtggtggctcatgcctgtaatcccagcactttgggaggtcgaggcgggtggatcacctgaggttaggagtttgagaccagcccggccaacatagtaaaaccccatctctactaaaaatataaaaactagccaggcatggtggtgggtgcctgtaatctcagctactcgggaggctgaggcaggagaattgcttgaacccaggagacggaagttgcagtgagcccacacggtgccactgcactccagcctcggcgacaagagtgagactccgtctcaaaaagaaagaaaaaatcccagacagtgaaagagaagctactcgtctagtacaactcttaacttgtaccaaataggtatcaagggcaagaaaaggtggcttatgtgagatcacagtgcacattaatggcagagcttggtttaagcccagctgctttgtcttctaaactgtgccatatactgcctgcaaatgtgcttctgttttacatggtcttaagagcttttcccactctttctcaagaccattgccatgtgtgctgtaaagccgttttacttgtggattttacatggatcactgttagaatgtcataaaatgatatcataaaagatcaactttcctggccgggcatggtagctcacacctgtaatcccagcactttgggaggccaaggcaggtggatcacctgaggtcgggaattcgagaccagcctgaccaacatggagaaaccccatctctactaaaaatacaaaaaattagctgggcgtggtggcacatgcctgtaattgcagctactcgggaggctgaggtaggagaatcgcttgaacccgggagttggaggttgcggtgagctgagatcgtgccattgcactctagcctgggcaaaaggagcgaaactccatctcaaaaaaaaaaaaaaaaaaaaaggatcaacttttggtcaggcgtgttggcttacgcctgtaattccagcgctttgggaggccgaggcaggcagatcacgaggtcaggagttcaagatcaccctggccaacatggtgaaaccccgtctctactaaaaatacaaaagttacctgggcatagtggcagatgcttgtaatcccagctactcgggaggctgaggcaggagaattgcttgtgaaccgggaccctggaggcagaggttgcagtgagccaagatcgcacaactgcgaactgcgctccagcgtgggctgcagaggcagactccgtctcaagaaaaaaaaaaatcagctttctttccttcccctgaatcttctgcagtgccagtttcatcctcaggcccacttgtttcatgtagacaaaaggccaaccaggtttcatattcacgtatcaacccctgcagtaggagaaaaggccactcctaggagctctggtattttccagaagctttcagtcagccttcccttgtatcagcccaaatcaagtcacatgaaatttctaagccagcccctgtgatcagggaatgccattctataacacaagttccctaaagcagtaactatagaagaaagaattaccctaattgtttcaggccaattaaggcccatcctagaggtggaaatggggtcagcatactcagaagcaaagaagtagagagagttggatacctgaataaaattgggaaaagttacaaagagaggaatggatgctggagaggaaccaccagtttctactacgataacctatttacttcattttaaacggtgatattttaaacgtgggaacattttgcctagtgagtttttttctttgagaaacgtagcagtatcttgtaacaaagaagatatggggacactctgtcatcaaaaactactttggggccgggcatggtggctcacacctgtaatcccagcactttgggaggccaaggtgggtggatcacctgaggtcaggagttcaagaccagcctggccaccatggtgaaaccccacctctactaaaaattacaaaaattagctgggcgtggtggtacatgactgtaatctcagctacttgggaggctgaagcaggagaattgcttgaacccgggaatcagaagctgcagtgagccgggatcacaccactgcactccagcctgggtgacagagcaaggctctgtctcaataacaacaacaaaaaaacagaaacaaacaaaacaaaacaaactactgttggaggtaggaactggcccaggggctgtattcccagaacacgattcccttttccccactgcaaacaagatagtctacagcagcctcacaacttaattgtctcacacaggactattcctactgttaagagatcacagctaaggcttgggcaccttgacctgctgtagaagctcagttaatgtacttttcatcatctgggccctggtattcccctgtaaatactgaagtagacccagtgacctagtgcccaagacacaaaatattcagcctccgtaacatttgtctaatgacatggttctagctttgctcactcccattaatttcaagtgagtactggctaggcagtctatagtgacttgattacactgtctttcttgtcctgtgctgtcctgagaatcctggatttgaagcagcctatgaataaggtttgaaaaatatttatccaactatgccgacatatgatgttctagcactgcatctgtcatctatcacccgcaccttaataaatgataattacttgtgcaaacatgatgtattaatcacttattaacttggttgcttacttgacagacactgctaggtggtttgcctatgctgtacttcgacagatcctgggaaagaacagcctggctcattatgccctggaggcaggagcagagatttcagacttctgatttctgtgagccattccacactttcctctcggttaggggagggacagcaataaccagaggatgaaggtggaacctttgcagtgcacacctaggccagtgcagtggcttatgcctgtaatcccagcactttgggaggctgaggcgggtggatcacttgaagtcaggagtttaagaccagcctgaccaatatggcgaaaccctgtttctactacaaatacaaatattcgctgggcatggcaatgcatgcctgtagtcccagctacttgggaggctgaggcctgagaattgcttgaacccaggaggcagaggttgcagtgagccaagatcatgccactgcattccagcctgggcgacagagattccatcttgaaaaataaagttccaaatacctaaatgctcaaactttaggaggcagctctctgggctgtgggctgtcagcatccccctcctagattccagggatttggttacatagttctttagctgtaatgcagagtataaattttagaacccacatggccccaaattcaaattgttttaatgcatgtaactagtgactaaaaacttagaatttcaatttacatccaagaggtggcaccataacacaacagcaaaaagccacacaaactgaaactcgtttccttttgtagtgaacagcactattaggtagtctgcagtgcctgactacgggctcacatgctgtgatccttctcgttttctcagagccattccttaagcttagtccccttgtatcttaaatttagctcaggtcggagtgttgttaacttggggccagctgggttcgtgagagtctcagcccattgccatggtggagtcagcatggtcttgagttccttccttaactctgcaggtttcagaaatccacgtagccagtgtttctgaaaatggatctaggctgggcaattggcaaggagctaatttcttatcaagatgccagcttattaacttgagtgaagaacacaactgccaaatagactgtatagtgggatctgctagtgagaacattctgtccctttgggaaatctctttaagagaatcatcatttgaaggctgcttggagagcctggaatcagagccagggaaattaggggccagggtaagggagctatgaccatctatagctcccatttctgctgcagggatggacctatggtatcagccagccacagaaggtcttttgggacaacactggagataatgatccttcatagtacaggaactccctttttctaggttgcaggaagaccacctatttctacccacataggcattcctcagacaatcctcataatttagttattaagggtttttgcattttataatcctgtctgcctcagggtccatcggtcccctagatagagtttggggagggaagaatccccaaactttgcagccacaagttacgtactccctggtcatttctacagaaaactaatctgtgatgtgtttttactatcgcagtgacgttcaaactgtttcaaagccttaggtttccccagagatgcctagggggattggggcactgtggacaataagggagtgagtcaagtcaacagaaatgctagctagcctttagttctcttctacagccgtactgggtggcatgtacacgtgatagctgctcacaccacatgtggctattgagcacttgaaatgtggctaacataatttaaaagtaaaaggtaaggctggccatgttggctcacgcttgtaatcccagcactttgggaagctgaggtaggaggatagtttgtggccaggagtttgagaccagcttgggcgacgtggtaagaccccatttctccaaaaaaaattaaaaaaattaactaggcatggtggtgtgtgcctgtagtctcagctacttgcgaggctgaggcaggaggatcacttgagctcaggagttcgacgtagtgagccatgattgcgccactgcactccagcttgggtgagagggcaagacgctgtctcaaataaataaaaatgagccccctccccctccccctccccctctccctcaccctctccctctccccacggtctccctctgatgccaagccaaagctggactgtactgctgccatctcggctcactgcaacctccctgcctgattctcctgcctcagcctgcccagtgcctgtgattgcaggcgcgcgccgccacgcctgactggttttggtggagacggggtttcgctgtgttggccgggccggtctccagcccctaaccacgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcatctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccatctgagaagtgaggagcctctccgcccggcagccaccccatctgggaagtgaggagcgtctccgcccggcagccaccccgtccgggagggaggtgggggggggtcagtcccccgcccggccagccaccccatccgggagggaggtgggggggtcagccccccgcctggccagccgtgccgtccgggagggaggtggggggtcagccccccgcccggccagccgccccgtccgggaggtgaggggcgcctctgcccggccgcccctactgggaagtgaggagcccctcagcccggccagccaccccgtccgggagggagatggggggtcagccgccccgtccgggagggaggtgggggggtcagccccccgcctggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcagcccccctgccctgccagccgccccgtctgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagagatcggatggttgctgtgtctgtgtggaaagaagtagacatgggagacttttcattttgttctgcactaagaaaaattcctctgccttgggatcctgttgatctgtgaccttgcccccaaccctgtgctctctgaaacatgcgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctgccaaatccccctctgtgagaaacacccaagaattatcaataaaaaaataaattaaaaaaaaataaaaataaataaataaaaatgaaaaacaaaagcataatagaaataaagaccatgttggaaacagtgcaacagagaagaggctgaaaacggtatgaaatttagaaggcaagatagagaacagtgaataaagacaggaaaataacagctatagaagtcagttaaaaataataataataattattattattattattattatttgagacgaagtttcgctcttgttgcctaggctggagtgcagtggttcaatcttggctcactgcaacctccgcctcccaggttcaagcgattctcctgcctcagccttccaagtagctgggattacaggcctgagccaccatgcctggctaaatttttttcttgttgttgtatttttagtagagacggggtttcaccatgttggccaggctggtctcagactcctgacctcaggcgatccatccgccttggcctcccaaattactgggattacaggcgtgaaccactgcatccagccaaaattattcatttttgtattgtttcactttttatattttttattttattttattattttattttattttaattttattttgagacggagtctcactctgtcacccaggctggagtgcagtgtcgcagtctcggcctactgcaagttctgcgtcctgggttcacgccattctcctgcctcagcctcctgagtagctgggactgcaggtgcccgccaccacgcccggctaatttctttttgtatttttagtagagacggggtttcaccgtgttagccagaatggtctcgatctcctgacctcgtgatccgcctgcctcggcctcccaaagtactgggattacaggcgtgagccaccgcgccagctttattattttgtaaacacacaagttgaggaaattttaaaatgagaaaaatacacacacaaacaacaaagctctagccattagcaattagaacagctttatttacctaattcagacaaagagactggagattctttagggagttaaaggcacgagcagtggaaaaaaaccatgagatcatcatcacatcatcccctgaagctgtctcaggaggagtcactgaaacccagagaaaatctaactggtaattaatacatagggctctcgtgtccctgagggaaaggagtgaaaacaccaactgaattagcccatacatggggctgtctgtgccctttagggagaggagtgaaaacaactgaaatcagcccatcagcccatgaagacactggtgaaaattatgcgacttgtccttcttgcacctaagcagcccacagataactcactcttatatacgaacctgactgactgggtagccattatgtgcctagcttagtgctgcatgctttatgctctctcttaatcctgcaatggggcagtcgaatcacatattagctgtttttgttgcctgtttgtttttgagacggagtctcgctcggtcacccaggctggagtgcagtggtgcaatcttggctcactgcaacctccgcctcctgggttcaagcgattctcctgcctcagcctccggagtagctgggattacagtcatgtaccaccacacccagctaatttttgtatttttagtagagatggggttttgccatgttggccaggctggtctggaactcctgacctcaggtgatccttccaccttggcctcccaaagtgatgggattacaggcgtgagccaccgtgcctggccagctgttctgactgaagacttgtcttcttcgttaacctgctcctcctgtttcatcctgcaaatgtttaaatctgaggggtattatccacagctcatctccacttttctaatctgacagcactgataattgaattcctcagaagcaagatgtttctctggcacccagaggcctcagcagtgtcacgacagctgaagtgtcacttattcctcatcctgggcacaccatgatggagtgcagccccactgattgggacccatgcagccagcctggcccagggccactctctctcccagaatgtgcacaagtcaagggatctctacttccatccttattttcctcaaaagctggtgccagcagtaatcaaccagacttctagaaaagaggagataatctgctctcaaggctgctgtgggctccagtgttgtaatctactacttgaatctagttgtttatttcattctataataatttaatacagcagatgtcaggagaaatctttgtttagatattatgtcatatctggatatatctgaatcctgaatgattaatctaaatattaacaatattcacttctgccaatgtcaagagtattttctgctactgggcttaaatcaattttaaaatttgagagttttaaaagcatatctttctgtgttcataaataaacagaacgaagatt

SEQ ID NO: 118354 - DNA, 518 bp, Homo sapiens
  Payload ID: 3159
  Gene Symbol: C15orf40
  Gene Name: chromosome 15 open reading frame 40
  Uniprot ID: Q8WUR7
  ENST ID: ENST00000451195
  CDS Start-End: 1-504
atgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagacaggatcttgctacattgcccaggctggcctcgaactcctggcttcaagtgatcttcccgcctcggcctcccagagtgctgggataacaggtgtgagccaccatacccaaccagctttattactgatttccctctaaaaagagactcaagt

SEQ ID NO: 118355 - DNA, 287 bp, Homo sapiens
  Payload ID: 3159
  Gene Symbol: C15orf40
  Gene Name: chromosome 15 open reading frame 40
  ENST ID: ENST00000510873
  CDS Start-End: 1-287
ctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagctctgctattccattcctcaacaattggaggagactcaggagggcgtttcag

SEQ ID NO: 118356 - DNA, 505 bp, Homo sapiens
  Payload ID: 3159
  Gene Symbol: C15orf40
  Gene Name: chromosome 15 open reading frame 40
  ENST ID: ENST00000512638
  CDS Start-End: 1-110
ccgctcggcttctttgcgccgagatgcctaagaaggctggtgcgacgaccaaggccagtagcagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagacaggatcttgctacattgcccaggctggcctcgaactcctggcttcaagtgatcttcccgcctcggcctcccagagtgctgggataacagctttattactgatttccctctaaaaagagactcaagtgtggagctgactcatctatagattaaggaatcacaaagtaccatagtcacttaacaaa

SEQ ID NO: 118357 - DNA, 457 bp, Homo sapiens
  Payload ID: 3159
  Gene Symbol: C15orf40
  Gene Name: chromosome 15 open reading frame 40
  ENST ID: ENST00000514272
  CDS Start-End: 1-258
aatgctgagctctgtcggtatctttccaaggtcctagaactcaggaagagtgatgtggttttggataagggtctctcactttgtcacccaggctggagcacagcggcacaacctcgggtcactgcagccttgacttccctggctcaaacaatcctcccacctcagcctcccaagttgctggaactacaggtgcatgccacccacacccggctaattttcgtattttttgaagagacgggatctcgccatgttgcctaggctggaagtcttgggcttcggtgatcctcctgccttggcttcccaaagtgctgggattacaggcatgagccactgtgcctggcccgaattatttttcttactttattaacttccaataaaaggtttgggacaaaaagatgtgacaatggaagctattgtgataacttcttcattagtctgcctttcctccaaacatatg

SEQ ID NO: 118358 - DNA, 561 bp, Homo sapiens
  Payload ID: 3159
  Gene Symbol: C15orf40
  Gene Name: chromosome 15 open reading frame 40
  Uniprot ID: Q8WUR7
  ENST ID: ENST00000538348
  CDS Start-End: 1-450
atgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagctctgctattccattcctcaacaattggaggagactcaggagggcgtttcaggtattcctgatactccttgtcattttctgtgaatctactagcaaacatctcttcaaactttggaacagcttcggcagtgtcagtcattctgaaaatctgtacaattttaaagacatttccattaaaaaaaatttaaaaattaa

SEQ ID NO: 118359 - DNA, 419 bp, Homo sapiens
  Payload ID: 3159
  Gene Symbol: C15orf40
  Gene Name: chromosome 15 open reading frame 40
  ENST ID: ENST00000563387
  CDS Start-End: 1-104
ggcttctttgcgccgagatgcctaagaaggctggtgcgacgaccaaggccagtagcagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagaagttgagagacttactcaagattgtaccatgcaagctggcaactagaacccaaatccttggactacttgttgaatgcagtttttctagattgtaaattaaaaatc

SEQ ID NO: 118360 - DNA, 631 bp, Homo sapiens
  Payload ID: 3159
  Gene Symbol: C15orf40
  Gene Name: chromosome 15 open reading frame 40
  ENST ID: ENST00000508990
  CDS Start-End: 1-440
tgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaattttttttttacatcttttaaagactatatttaccattttgttgaaaaagta

SEQ ID NO: 118361 - DNA, 559 bp, Homo sapiens
  Payload ID: 3159
  Gene Symbol: C15orf40
  Gene Name: chromosome 15 open reading frame 40
  ENST ID: ENST00000565712
  CDS Start-End: 35-241
gcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaa

SEQ ID NO: 118362 - DNA, 2578 bp, Homo sapiens
  Payload ID: 3160
  Gene Symbol: C15orf41
  Gene Name: chromosome 15 open reading frame 41
  Uniprot ID: Q9Y2V0
  ENST ID: ENST00000338183
  CDS Start-End: 249-800
agattgcatactcaagaagaggaggaacataaaatacgtgatgtcttctcttaagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaatt

SEQ ID NO: 118363 - DNA, 2240 bp, Homo sapiens
  Payload ID: 3160
  Gene Symbol: C15orf41
  Gene Name: chromosome 15 open reading frame 41
  Uniprot ID: Q9Y2V0
  ENST ID: ENST00000437989
  CDS Start-End: 18-863
ctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaa

SEQ ID NO: 118364 - DNA, 715 bp, Homo sapiens
  Payload ID: 3160
  Gene Symbol: C15orf41
  Gene Name: chromosome 15 open reading frame 41
  ENST ID: ENST00000562489
  CDS Start-End: 70-387
gacttcaggtgaaggacaggcagcaggagcagatgagatttagaataccaagactgtgtgtacacgcagatgtcagtggcagagaatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtg

SEQ ID NO: 118365 - DNA, 564 bp, Homo sapiens
  Payload ID: 3160
  Gene Symbol: C15orf41
  Gene Name: chromosome 15 open reading frame 41
  ENST ID: ENST00000566807
  CDS Start-End: 198-564
tctttaataccaccccatttcctcaaagctcagctttctgtttagttgtgaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtg

SEQ ID NO: 118366 - DNA, 2866 bp, Homo sapiens
  Payload ID: 3160
  Gene Symbol: C15orf41
  Gene Name: chromosome 15 open reading frame 41
  Uniprot ID: Q9Y2V0
  ENST ID: ENST00000566621
  CDS Start-End: 251-1096
aagccaagctagggcactctggtgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaaca

SEQ ID NO: 118367 - DNA, 772 bp, Homo sapiens
  Payload ID: 3160
  Gene Symbol: C15orf41
  Gene Name: chromosome 15 open reading frame 41
  ENST ID: ENST00000563167
  CDS Start-End: 160-360
tcattccctggtatttcgagaatatgggagagaaccagtgtgccacacttaccaggtctttatcacctctgtgctgagtccagcaaggagaagcgttgatgcctttattcaacaaattcctatgaggactggagtagataaataagtttgaccccgaacatgatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagta

SEQ ID NO: 118368 - DNA, 1325 bp, Homo sapiens
  Payload ID: 3160
  Gene Symbol: C15orf41
  Gene Name: chromosome 15 open reading frame 41
  ENST ID: ENST00000569302
  CDS Start-End: 14-877
tccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgtaatgctttgtcccttagctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcac

SEQ ID NO: 118369 - DNA, 2618 bp, Homo sapiens
  Payload ID: 3160
  Gene Symbol: C15orf41
  Gene Name: chromosome 15 open reading frame 41
  Uniprot ID: Q9Y2V0
  ENST ID: ENST00000567389
  CDS Start-End: 274-825
aagctcagctttctgtttagttgtgagattgcatactcaagaagaggaggaacataaaatacgtgatgtcttctcttaagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaagg

SEQ ID NO: 118370 - DNA, 524 bp, Homo sapiens
  Payload ID: 3160
  Gene Symbol: C15orf41
  Gene Name: chromosome 15 open reading frame 41
  ENST ID: ENST00000564586
  CDS Start-End: 220-524
agtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatca

SEQ ID NO: 118371 - DNA, 764 bp, Homo sapiens
  Payload ID: 3160
  Gene Symbol: C15orf41
  Gene Name: chromosome 15 open reading frame 41
  Uniprot ID: Q9Y2V0
  ENST ID: ENST00000562877
  CDS Start-End: 213-764
agctttctgtttagttgtgtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttga

SEQ ID NO: 118372 - DNA, 1281 bp, Homo sapiens
  Payload ID: 3161
  Gene Symbol: C15orf43
  Gene Name: chromosome 15 open reading frame 43
  Uniprot ID: Q8NHR7
  ENST ID: ENST00000340827
  CDS Start-End: 18-680
acaggcttggcgacgccatgtttcaagggcagcgcggttggttttgcggcagcgttagccaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacaggttatatatcaattgatgccatgaagaaattccttggggagctacatgacttcattcctggaacctcaggatatttggcatatcatgttcaaaatgaaattaatatgtctgctataaaaaacaaattgaagaggaaatagtaaattaaattgtaaataccttggcatttattttctataaaatattatacagatgtgcatatcataaaatgctcccttttggtactgggggatagtgaaatgggaaataatttttctgtttctcaaagtatatctttaggaaatacagaatcattttggttctgtgttttgacatttttcccctagcttttaacaacatgttcaaatattctcaatgcacagttgttaatgagtaattgccgttaaaatatatttcataagaagtctcaatctcaaactctccatctctcaatcctcctcctcctcctctttcttgctttctcttttccctctctctttctctcctccccttctctctttctgtctttcaaatgttcttttggctttaacattctattaattatattttttctagattgaatactgtgaatgctaagttttattaatctggtcatcttattttgattttaaaaattaggatgctagttgcattctgaattactgtttctggtttgaaacatggagaaaaacattttaataattcatatttcatgttggatggtttctaataataaatatctcaaaagtgacttaacataaa

SEQ ID NO: 118373 - DNA, 775 bp, Homo sapiens
  Payload ID: 3161
  Gene Symbol: C15orf43
  Gene Name: chromosome 15 open reading frame 43
  ENST ID: ENST00000557864
  CDS Start-End: 1-131
gcggttggttttgcggcagcgttagccaggatctgaggcaattctggggtaggaagctgagtggaagcagcgggttaggtggtgaggggagcatcctcctctctctgatgctttgggtccagggtgcttgataggttcaccctgtgctcttacctccacagtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacagagatgaggtctcactgtgttgcccaggctggtctcgaactcctgggctcaagcaatcctcctgccttggcctcccaaagtgctgggattccaggttatatatcaattgatgccatgaagaaattccttggggagctacatgacttcattcctggaacctcaggatatttggcatatcatgttcaaaatgaaattaatatgtctgctataaaaaacaa

SEQ ID NO: 118374 - DNA, 796 bp, Homo sapiens
  Payload ID: 3161
  Gene Symbol: C15orf43
  Gene Name: chromosome 15 open reading frame 43
  ENST ID: ENST00000559137
  CDS Start-End: 10-156
ggcgacgccatgtttcaagggcagcgcggttggttttgcggcagcgttagccaggatctgaggcaattctggggtaggaagctgagtggaagcagcgggttaggtggtgaggggagcatcctcctctctctgatgctttgggtccagggtgcttgataggttcaccctgtgctcttacctccacagtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacaggttatatatcaattgatgccatgaagaaattccttggggagctacatgacttcattcctggaacctcaggatatttggcatatcatgttcaaaatgaaattaatatgtctgctataaaaaacaaattgaagaggaaatagtaaattaaatt

SEQ ID NO: 118375 - DNA, 875 bp, Homo sapiens
  Payload ID: 3162
  Gene Symbol: C15orf48
  Gene Name: chromosome 15 open reading frame 48
  Uniprot ID: Q9C002
  ENST ID: ENST00000344300
  CDS Start-End: 191-442
gttcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatttctgtgtaa

SEQ ID NO: 118376 - DNA, 732 bp, Homo sapiens
  Payload ID: 3162
  Gene Symbol: C15orf48
  Gene Name: chromosome 15 open reading frame 48
  Uniprot ID: Q9C002
  ENST ID: ENST00000396650
  CDS Start-End: 155-406
gcgtgaccagagcgcgctggcccggcccacccggggcggttgtggtcgctatatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaaga

SEQ ID NO: 118377 - DNA, 500 bp, Homo sapiens
  Payload ID: 3162
  Gene Symbol: C15orf48
  Gene Name: chromosome 15 open reading frame 48
  ENST ID: ENST00000558435
  CDS Start-End: 105-500
atatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaaggtctcggctcctgcatactgcaagctgggtgccttccttctacagaacccatgcccccttgcaaggaaaccatggaatttccccaggagtcttcgacaactccaggccacaggaaggtcacaaatggtcagaaaaggaatgaatttgaaggaggaagaaccagccctgcccacgttgtctggggcccctcccaaggggacaggaaagctccac

SEQ ID NO: 118378 - DNA, 4717 bp, Homo sapiens
  Payload ID: 3163
  Gene Symbol: C15orf52
  Gene Name: chromosome 15 open reading frame 52
  Uniprot ID: Q6ZUT6
  ENST ID: ENST00000397536
  CDS Start-End: 37-1011
ggtgctacggagatcctccccattttacacgaggaaatgagacacagagagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtcggggcgggcaagccagcagaccctcggtggcaccagccacaggcagcaaagcccggggcaaggagaggctgactggcagggcccgaaggtgggatatgaaggaagacaaggaggagctggaaggtcaggagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatgggttgggatggggagcgacaacctcctcttcccacagcaggatgggagagcttactcccaggcccccacacccaggtcagacatcacgtgcaccctgaatgtaggcaagggcctggccctgcagcccagggtcatttcctgctctttccacttcctctttccccaccgtcctgcactagcaccagggccaggccaaggcaagaatcagacagctactccacagacagagaaacaacttccagctaagtatgacatcaggacttgtctttcctactaagcctccatccccgcccctcccctgaggcccacgtctgctgaattatccggactccgcacaagctgtggcttcctctcagttcaacaaacatttcctgagcacccactaccagtaatccagccggtaggcgacggagactgccagcaggagggagggaagaaagccagtcatccggcagatctgggctgttctgggcgggagctgttctgggccacaggtgccctacagggctgggggcaggatggcggtaggagccccaggggaccctcccacctctgcctggcagaagcaagtgcccttctttcttgttatgtgtgccttctgctcctgagccctagtgtggacctcaccgcatggtcccctctgccccctccttctggtcctgccatggctgctgctctctgctgaaggctgtggggctctagggagagtccagatcaccctgggatttctccactgcccaatgtgaagcctaaactgtggggtcccagctcagccttcctcactggctctcaactccaccccacccctctattcaggaaggtgaggggcatctctttagcagaccagactgttttgagaagtgtctctcatactttaactgaagagtcatgcagattctaatggtctggggagggcctgagagttcgtcttttttttttttttttttttttagttagggtcctgctgttatcacctaggctggagtgcagtggcacaatcatggctcactgcagcctcgaaccctccaggctcaggcgatcctctcacatcaacctcttgagtagccgggactacaggtgtgccaccacacctggctaatttttgtattttttgtagaggcagggtttcaccatgttgcccaggctggtctccaactcctgggctcaagcaatctgctcgccttggcctcctaaactgctgggattacaggcatgagccaccacacctggccgagaattcgtatttctaagaggcttcaggtgaagcccatgctggttcctggaccatggttttgagtagttaagggtttggactagaatatatgaagggctgggggtgaagacagactctagactctaaaggttggtggctggctatgtaggggatgggggagtgctacccctgtcaggtggtgggggcttcctggctgcagagttgggtgggagacttggggaagatgctttggaaggcagtgagtgggtggtgtcaacttctagtagtgcagtgggagagctggtcagggatgggatggagtgaagggggcagaggcatttggtgtggggttgatcagaggaattttggaaaggcttggaaacattcctatgtatgtgagacacacctatgccagggcaaagactccaagctcaagtttttctcttgccttctagtcacaagaacatggctttggagtgtgacactggcctaggaatccatgactcccaaaggacggggctaggggtagaggaggttcaggcaaagcccttagattttggagacatcaggcagatgtctccaaaaatgattgtgatcaagaatctgaattataagattcacagtctgctccccaacccagtgctgccaactgtacagctgcgcctccacgaaggggcatatgccaggctcgtctgaccctggaatgaggatgtaggaagcaggcagagctcgggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgtcccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtga

SEQ ID NO: 118379 - DNA, 541 bp, Homo sapiens
  Payload ID: 3163
  Gene Symbol: C15orf52
  Gene Name: chromosome 15 open reading frame 52
  ENST ID: ENST00000558858
  CDS Start-End: 438-541
aaaccatttccacgggagagctggaacaggcctaatttttagctggagatgtggaaaccttgagagaggaagcgcctggagtctccaaaccccaccccaagcctcttcctgcttctccccctcactctgagtgtcttctccctacagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtgggatatgaaggaagacaaggaggagctggaaggtcaggagggaagccaaagcaccagagagactcccagtgaggaggagcaagcccagaagcagagcgggatggagca

SEQ ID NO: 118380 - DNA, 572 bp, Homo sapiens
  Payload ID: 3163
  Gene Symbol: C15orf52
  Gene Name: chromosome 15 open reading frame 52
  ENST ID: ENST00000560922
  CDS Start-End: 52-572
aggagcttgggttccctgcctctgcagggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccgga

SEQ ID NO: 118381 - DNA, 3022 bp, Homo sapiens
  Payload ID: 3163
  Gene Symbol: C15orf52
  Gene Name: chromosome 15 open reading frame 52
  Uniprot ID: Q6ZUT6
  ENST ID: ENST00000559313
  CDS Start-End: 17-1621
cttttgtaatcacaacatgatctcgtgtgctgagcagcgaagccggcagggagaggccggcagaggcccggctccggtggctccagctttcctcccactctggctccccaggggctgctctggaattctctcggtgcccgccgttgccatgcactcggctggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtcggggcgggcaagccagcagaccctcggtggcaccagccacaggcagcaaagcccggggcaaggagaggctgactggcagggcccgaaggtgggatatgaaggaagacaaggaggagctggaaggtcaggagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatgggttgggatggggagcgacaacctcctcttcccacagcaggatgggagagcttactcccaggcccccacacccaggtcagacatcacgtgcaccctgaatgtaggcaagggcctggccctgcagcccagggtcatttcctgctctttccacttcctctttccccaccgtcctgcactagcaccagggccaggccaaggcaagaatcagacagctactccacagacagagaaacaacttccagctaagtatgacatcaggacttgtctttcctactaagcctccatccccgcccctcccctgaggcccacgtctgctgaattatccggactccgcacaagctgtggcttcctctcagttcaacaaacatttcctgagcacccactaccagtaatccagccggtaggcgacggagactgccagcaggagggagggaagaaagccagtcatccggcagatctgggctgttctgggcgggagctgttctgggccacaggtgccctacagggctgggggcaggatggcggtaggagccccaggggaccctcccacctctgcctggcagaagcaagtgcccttctttcttgttatgtgtgccttctgctcctgagccctagtgtggacctcaccgcatggtcccctctgccccctccttctggtcctgccatggctgctgctctctgctgaaggctgtggggctctagggagagtccagatcaccctgggatttctccactgcccaatgtgaagcctaaactgtggg

SEQ ID NO: 118382 - DNA, 2043 bp, Homo sapiens
  Payload ID: 3164
  Gene Symbol: C15orf53
  Gene Name: chromosome 15 open reading frame 53
  Uniprot ID: Q8NAA6
  ENST ID: ENST00000318792
  CDS Start-End: 11-550
ctgttctgatatggagctacaaggggcccaagaggacctgggcatttccctctctagtccccggaggaaccatgaaaccaggccaggaagcaaggctaagggcaggagcagcatctgtctccaggcgtctgtttggatggctggaggaaagctgaggctcagagcaagtgaacatctaacccagggccaccaacaagagctcagggattggaatctgggagaagatgcttcccttctcttctccaagagtccttttggggctggcaagttgatacaagctccagctcatgtcttcagacaatgctgggtccaaggaaatgcatggatctcctgcattacaaagtttgactccaagagaagcccagaagtggcttccagcccctcctacctaactgtgccccgccgttcaccacttcctgtcttcctgcgacccagtgacagatgtgtctgtgggggctgctacttgggaaagtccaccaggaggagagcatgccaatctctcctctcagatcctctgggggttactttccccacccaaactaggccttgatgtcaaggcctagttacagggatgtcaaactaggaggttgatgtcggtgtggtgtgtaagatgttggggagaagctgcaggtgccttcttaccagctcttcctgaaaacttgtctctccctctccttgttagtctgttttataactcacactccagccggggggaagtaaaggagcttatcccgttcacagatcctgtaacccatggtggttattacctcatagctggtgcagtgttctttgagcctagcagtttggtttagactcaagtgtctattctttgcagtctttctggggttggtagcagagaaagagaagagaacaggtaattcgatcactcaggttattcgtgtgtaaaagttgaagccctaccacaaacgtatgagtggatgttatagtgtaataacctggacattgccaagacagcttcctcagggcttttgtttcctcaagcctacctgaaggctctcttctcagtcacgggggatggaattgtttcatccctggcttgctctgggcctcagtttccctattccaggatagtttccctattccctattctgcatcataaaaaaaaaaatacactcctgatagaagtcggttgatgcttttggcctgcagcctccttaaggttaatagtccacataatttcctcaggggccctggctggcctgttgtgggtgtacccatgaagtatcttgatttgctatgataggagccaccttggcttcctgtggagataagccctgcccctcgttcccactttaagcttgaaaagtcccttatccaactttggaatgggaactagaaagactaagcagtgtctctcaggggttccttctggggtcactcagaagaggagaaccaagcagtcttggcggagagacacctgaagttggtcactcggcacattaccaggggctcagcaatgaccagcctgcaaccatcctgcctttccccaggggtctgggctccagccatggagggtggactggagactcctttgcctttcaacactgtctggcctgtctcgggtccggcacgtcttttctctactgattttgtggctgtggttaacttagctaacctttcagtgaaataatgtctagtggcattcctttacattttccatgtgctgttttttccataactccattttcttcagggctgagtttgggtcttcatttttccacccacaggcctagttaagcttggtcttgtgctccaacttacctgccccagacttcttggatggacattgtcaatctggtcatattgagagtgaaactgccacctagtggtcactggaggtgtgcctgccttttcatgagctctcttgctgctggttaccggaaacatcagttgatggttttcttctaagctaactcagaagctgtgatgtgaatcagaccaaacaatttatctgcttcaaatccatattgtaaagaggtttaatataaagacatattttcaaatcaaaataaataatgaagc

SEQ ID NO: 118383 - DNA, 1704 bp, Homo sapiens
  Payload ID: 3165
  Gene Symbol: C15orf57
  Gene Name: chromosome 15 open reading frame 57
  Uniprot ID: Q9BV29
  ENST ID: ENST00000358005
  CDS Start-End: 275-832
gggactccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaa

SEQ ID NO: 118384 - DNA, 1519 bp, Homo sapiens
  Payload ID: 3165
  Gene Symbol: C15orf57
  Gene Name: chromosome 15 open reading frame 57
  Uniprot ID: Q9BV29
  ENST ID: ENST00000416810
  CDS Start-End: 95-652
actaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaa

SEQ ID NO: 118385 - DNA, 1075 bp, Homo sapiens
  Payload ID: 3165
  Gene Symbol: C15orf57
  Gene Name: chromosome 15 open reading frame 57
  Uniprot ID: Q9BV29
  ENST ID: ENST00000558871
  CDS Start-End: 80-484
ccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtaatcgattccccgtctagttccagctgaaatcatcctttatgtagttgttctatttgtttttagcccagcagtagatttttaagaacagacttttttgccaaaaggcaaatactgcagctacgtgttggtcacagattgaatagagttaaggataaagcattgtgttcatttttaagtatgcaatgaacttgagaaagtagtaactaatcagtctctcatgttcttgaattctttctcatgaggtttggaaaccatgttactgtaacaaaaggaaaaaccatttactcctcagagagattattttctggaactatctcttcatctcttcttacctctgaatttccactgctttacagattttttttttttttttttgagatggaatctcgctctgttgcccaggctggagtgcagtggcacgatctcggctcactgcaatctctgcctcctgggttcaagcaattcttgtgcctcagcttcctgagtagccgggactacaggcgtgtgccacaacacccggctaatttttgtatttttagtagagatggagtttcaccatgttggccaggctggtctcaaacttctgacctca

SEQ ID NO: 118386 - DNA, 814 bp, Homo sapiens
  Payload ID: 3165
  Gene Symbol: C15orf57
  Gene Name: chromosome 15 open reading frame 57
  Uniprot ID: Q9BV29
  ENST ID: ENST00000558750
  CDS Start-End: 201-785
ttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctggggtaaggggccatgcggggctctggtctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacac

SEQ ID NO: 118387 - DNA, 576 bp, Homo sapiens
  Payload ID: 3165
  Gene Symbol: C15orf57
  Gene Name: chromosome 15 open reading frame 57
  ENST ID: ENST00000558113
  CDS Start-End: 49-570
agagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggccctgtaactccagaacccctggcagcagcagcttttctgaggatggagcgtgggacagccaccagtgtgctgagcagaggtggcgaaggacatttccagcccagcagtcgtcatggtaacagcca

SEQ ID NO: 118388 - DNA, 6131 bp, Homo sapiens
  Payload ID: 3165
  Gene Symbol: C15orf57
  Gene Name: chromosome 15 open reading frame 57
  Uniprot ID: Q9BV29
  ENST ID: ENST00000559291
  CDS Start-End: 27-584
gggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagccctgtaactccagaacccctggcagcagcagcttttctgaggatggagcgtgggacagccaccagtgtgctgagcagaggtggcgaaggacatttccagcccagcagtcgtcatggtaacagccagggcgggccaggcagggatgtgcagaaccatgtgggattgacctttctgtggtgtcaggtttgagcgggagctggggagaaacagcaacaactacttccctctggcccagccctcagggcttctgggctgggctgaatgaagaaagggagaagctgagaagtgggacagctggcgagagagccaagagagagacagggctttagtcagagccagctagagaacccatgggaagagggacaggctggtcaccagcaggctcctgcggtgagcccacctgtggcaagcactagacctcaggcccccagttggcagcgctcatgggtgggtactaaaggtcagttccctatactcagagctcccccagactccttcagatcaaatgtcaccttttccatattgcaaaagcctttattgctctaaggaaaacatgctaaattaaaaagaaccaaattattcttttaaaaatagaaatattttaaatggaaaagttcaaagaaaataaaaggctttccaatcctccctctgcttctcccagctctaaaattcctccacagttgcttcccatgcctgccaggttggaggaaagggacaggcctgggcccagcggcctcttctctgacaagggcacagaaagggaagccggattggtcgttgcctgaatttgaggggggcttggactcacaggcttcccgctaattcgaaccagtgaaggagactcatttccctctatgccccctctttctcctattggggcggacatacaggcagcagaaagaggtgcccacaggtgccctgtgaccccttgagggagaggcgaggggtgcagggcagcctcaggtgagctccatggagaacatagcttaccagtggatcccatttccagactttcaaatcatggccatgcaagagatctcgagctttctgggacacactgctatggaaaacaagaccatagcctcagaataaaaaatgtggtcttcttatttactgaaaatctaccttcaggaaagacatgaagggggcactcaccagccaataggtgggtaacttaacacagcagcaccacaggctttcttttatacaggagtacagtccccaaatccccttggagaactgcctctgggccacttgtacaggggaaggggacacttggcaggagaggggaccgcagaccttgtagtcataagttagcatgctgctaaaagactatttgaaatgagtgctgattacatatatttaaaagtggtcagcattactgaagctccagcttttttttctgaggcggagtcttactctatcacccaggctggaatgcagtggcaccatctcggctcactgcaacctccacctcccaggttcaagcaattctcctgcctcagcctccccagtagctgagattacaggtgcccactgccatgcctggctaatttttctatttttagtagagacggggtttcaccatgttggccaggttggtcttgaactcctgacctcaagtgatccgcccacctcagcctcccaaagtgctgggattacaggcatgagccaacgcgtctggccaagagccagcatttttgagactcgaacctttctctgactgacatgtattgtggagctcaaaataaacattctgtattttgggagttggtcatcactctctagttatgctcctgtagagctattactgaacctctggcctcttccctgggttctggaaaccttcatgtacccgtggcccccagagcaaggggtaggagacaggaaggctgctagtgccccgatggtcccacacgaggctgggaccttgggacacaggcactgcatcattcactgttccctgcatgggcttcaggagtggatgagagcccagggccaagccccttcctctttcgttctgcccaagccccttccctccagctgccttccctccttgagtcccttgattcctctgtgatcccccctccagctcagcacctggggctggcaccactccccagggatactgataaagtcacagagcatctgcccagcgcctgaggtggtgtaagttggggaaggtgggtcatcctgttagttgctcctgccaggcctggagcccctggtggtcctttagaattctagattctcttggttcctttctccagaatccttcccttctcgctccactcatgctctgggccaggcccaccacgtctcctggcagctgactatctcatgccacctgcctttgttctctattccctttgccaaaaccatattttctggtgaatccctcttctacttcaaggttcagttcaagtgccaccatataagtgaagctgtcctcagtcgaccctaggtgactctgtggccccatggaactttttctcatcaccatcgtagcagtcatgactctgttttgacctccacttctccactggagagtgtgttccgtggaatgaactggcttgtagtgtgacctgtgaacctccagagcttggctctgtgttgctcattgagtacttgttcttgcagtgggcccttgccaagagaggcccctgttctgggatgtgagccagagaaggtccgagactcataatttcatgtgtcatactcgtcctccacccagctccccctggccagatcacagccccctcctgctgcagggcctgtagtgccaggctggttgcaagacaggggtcctcacctctgagaaaatcatggcttggcccattggcaccccacctgggatgcagaatggagcagcaacagctggctggtgtctgaacgctatttccccagccctgggcagccatctcctgtagctgttccctcatcccatggctttaccaacccctccttgctgcactggagagcctgagagcaagtaggttcagagtgggaagacagggctaaaggcatcttcccggtcttctctccttccccttcctcccagcagttgcagctgtgctgcgtgatgatgtggaacagagcacagtcttaattactgctcagccctgctcattagtgcttctggaagcccaagaagccagagttaggaagcctcaatcacagtggagacccaggctgcaggcctcctgggtgatcgctagtcctgtgtctcctggtgacttgggacccctttgggggactccagcaaaagacactccctccaaccctgagactggggaagggctgaagctggagggagtcactgctggattaagggagtcgctgctggattaaccttcctcatgggcagctctgatcaaatacctatgtttctcttgctgacagcatagagtctggagtccttggcttagcagtcaagctcctccacaatttggtcccacaggactttcccaacctgatttcctccttcaatcctggcagacaaggagggaaggcaaaggctaggccccctcatgggctctcactagtgtgtgcagagcatttcagggacagcatatggtggaacgtgtgaaactccactgcaatcagagaaagatgaacgaatgattaaataaaccacatgtgctcaaatcccgcacactgatgacttccctgcttttggagagacttagcaaggagcctggtgtgttgttcagcatgcactattttttttcttttttttttttggttgtgaaaaggaataaagaaccatgaagtgcctgaagactgaacgaaaggaagctgagtggaggaggagagaaggggcgggccctgaaaactataaatctataggcccaatttcaatatgtggaaaaactccttcaaaatataaatttgtaaacaccctagatcaaatgagagaatgctcatgaaagcactttttgaactgcaaagggttagaaatataaagcattattctgtaatatttctgttcagtgcagactttaaaacagatgctatggagaggctggagatctatgataatggctcatcacctacaaggtgctcatacagtttgggctgtttcatttaattagtcattgcctctcatgtagactactgcagaagtctcctaagtggcctccccacctctgcattctcccccattccattcatcttatatgccaccgtcacgttaatcttcctgatgcacagctctgatcaaatacctgtaatgattctcctgctgactgcacagagcctggagtcgctggcttagcagtcaagaccctccacagtctggtcccccaggactttcccaaactgatttccttccatcacggcaggcatgggctcgggaagatcaagtcactaaacccaagaccacacagataccaagtggcagatcatacagccaagccttcagaccctgacatctgactccaagaccattctgagcccatcacttcctcactttgatggtgcaatggactgtgtgtttgtgtccctctaaaatatacatgttgaaacactaatcctgatgtgatggtatatggagatggaactttggggaggtaattaggtcatgagagtggaccctttatcaatgggattagtgcccttacaaaaaggggccagagacctagctagttctcttctgccatgtgaggatacaatgagaagtagacagttggtgatatggtttggctgtgtcccaatccaagtctcatcttgaattgtagttcccacaatccccacgtgtggtgggaaggacccagcgggaggtaactgaatcaagggggcagtttccctcatgctattcttgtgatagtaagttctcacgagatctgatggttttagaaggggcttcccccttcagtcggctctcattctccttcctgctgccctgtgaagaagaacatatttgcttccccttctgccatgaatgtaagtttcttgaggcgtccccagccatgccaaactgtgagccaattaaacctctttcctgtacaaa

SEQ ID NO: 118389 - DNA, 349 bp, Homo sapiens
  Payload ID: 3165
  Gene Symbol: C15orf57
  Gene Name: chromosome 15 open reading frame 57
  ENST ID: ENST00000558918
  CDS Start-End: 98-349
caggcgacagagctgagccaagcgtttactgggcagctgttacgagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagca

SEQ ID NO: 118390 - DNA, 557 bp, Homo sapiens
  Payload ID: 3165
  Gene Symbol: C15orf57
  Gene Name: chromosome 15 open reading frame 57
  ENST ID: ENST00000560305
  CDS Start-End: 49-498
agagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagttttttgagaaatgggatctgtgctaagggctttgggcaggccagctaggaggacggaagaagtttcccattcgcttgtggacaaggcctgcacccatataatcaact

SEQ ID NO: 118391 - DNA, 677 bp, Homo sapiens
  Payload ID: 3165
  Gene Symbol: C15orf57
  Gene Name: chromosome 15 open reading frame 57
  ENST ID: ENST00000559911
  CDS Start-End: 49-660
agagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggccctgtaactccagaacccctggcagcagcagcttttctgaggatggagcgtgggacagccaccagtgtgctgagcagaggtggcgaaggacatttccagcccagcagtcgtcatggcatgggctcgggaagatcaagtcactaaacccaagaccacacagataccaagtggcagatcatacagccaagccttcagaccctgacatctgactccaagaccattctga

SEQ ID NO: 118392 - DNA, 1918 bp, Homo sapiens
  Payload ID: 3165
  Gene Symbol: C15orf57
  Gene Name: chromosome 15 open reading frame 57
  Uniprot ID: Q9BV29
  ENST ID: ENST00000559153
  CDS Start-End: 13-570
ctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccttgagcgagaacccataatagaacaacttagcaaaatgttctttatgctaagtacggttggcatcttcgtggacattagcacagatgtcagaagaaaccggaacctccagaagacagatgatattgaggttcttggggaattaaagagaaatattaccctctgcctcatttgccattggagacagtgcaatctggtgtatgcactaataataataataacatgtcttttcatatttaaaaaaaaaacacaaaatctttaggaagccgaggtgggtggatcgcttgagtcaggagtttgagagcagcctgagcaacatagaccccatctctaaaaaaaattagccaagtgtggtgatgtgtgtctgtggtgccagctacttggaaggctgaggtaggaggattgcttgagctcaggaggttgaggctgcagagagtggtgatcatgcctctgcattccagccttggtgacagagcaagaccctgtctcaaacaacaacaacaacaaaaatcaaaatctatgcaaaatttaaacccaatcttgcgctagtcttgtgggaatgaagattaatttacctaaaaatgctcctctggtttttgtaattctttttgttactttttaaaaatataaatttggccaggcacggtggctcacacctgtaatatcagctactcgggaagctgaggcaggagaatcgcttgaacctgggaggcggaggttgcagtgagccgaggtcccgccactgcactccagcctgggtgacagagtgagactctgtctcaaaaaaaaaa

SEQ ID NO: 118393 - DNA, 557 bp, Homo sapiens
  Payload ID: 3165
  Gene Symbol: C15orf57
  Gene Name: chromosome 15 open reading frame 57
  ENST ID: ENST00000559103
  CDS Start-End: 47-557
gacagagctgagccaagcgtttactgggcagctgttacgattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccg

SEQ ID NO: 118394 - DNA, 1577 bp, Homo sapiens
  Payload ID: 3165
  Gene Symbol: C15orf57
  Gene Name: chromosome 15 open reading frame 57
  Uniprot ID: Q9BV29
  ENST ID: ENST00000561011
  CDS Start-End: 215-619
actgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccttgagcgagaacccataatagaacaacttagcaaaatgttctttatgctaagtacggttggcatcttcgtggacattagcacagatgtcagaagaaaccggaacctccagaagacagatgatattgaggttcttggggaattaaagagaaatattaccctctgcctcatttgccattggagacagtgcaatctggtgtatgcactaataataataataacatgtcttttcatatttaaaaaaaaaacacaaaatctttaggaagccgaggtgggtggatcgcttgagtcaggagtttgagagcagcctgagcaacatagaccccatctctaaaaaaaattagccaagtgtggtgatgtgtgtctgtggtgccagctacttggaaggctgaggtaggaggattgcttgagctcaggaggttgaggctgcagagagtggtgatcatgcctctgcattccagccttggtgacagagcaagaccctgtctcaaacaacaacaacaacaaaaatcaaaatctatgcaaaatttaaacccaatcttgcgctagtcttgtgggaatgaagattaatttacctaaaaatgctcctctggtttttgtaattctttttgttactttttaaaaatataaatttggccaggcacggtggctcacacctgtaatatcagctactcgggaagctgaggcaggagaatcgcttgaacctgggaggcggaggttgcagtgagccgaggtcccgccactgcactccagcctgggtgacagagtgagactctgtctc

SEQ ID NO: 118395 - DNA, 801 bp, Homo sapiens
  Payload ID: 3165
  Gene Symbol: C15orf57
  Gene Name: chromosome 15 open reading frame 57
  ENST ID: ENST00000625629
  CDS Start-End: 280-801
actaggggactccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggccctgtaactccagaacccctggcagcagcagcttttctgaggatggagcgtgggacagccaccagtgtgctgagcagaggtggcgaaggacatttccagcccagcagtcgtcatggtaa

SEQ ID NO: 118396 - DNA, 1342 bp, Homo sapiens
  Payload ID: 3166
  Gene Symbol: C15orf59
  Gene Name: chromosome 15 open reading frame 59
  Uniprot ID: Q2T9L4
  ENST ID: ENST00000379822
  CDS Start-End: 346-1227
ctgtgttcaagctcaggcagagatcagctctgcacacccacaggcacttcaagacctggaggccactcctgggacccaaggtccctccccctcctctcctgtgtcctcaccttgaccccctctgctagactctgtctccctctgggtgtcccactctccacccagaggcagaggaggctgggtggcagggggcaggggctggttgagggccgcccagggccagggtgggctggggggccgttaaaatgtggagctctgcccagccgaggggggctccgtggaggcagacgcagtgtgtgcccagctggggggagtatgggcaggcctgcggccacgtggtaaacgatgaacattcggggcgccccggacctcgggcagcccagtgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcagtgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgct

SEQ ID NO: 118397 - DNA, 779 bp, Homo sapiens
  Payload ID: 3166
  Gene Symbol: C15orf59
  Gene Name: chromosome 15 open reading frame 59
  ENST ID: ENST00000559817
  CDS Start-End: 321-779
aaatctgccggaccctcgctcattcccgaccccgagcctggagaggcttgagaaagatttttcctgcccccttccctggagcgcggaggccccgccccctcccaccgcccagatgtctccggtcacggctcggaggacctccctgaggcccggggccgaagggtccagagagagaagcccgccctagggagccttgggggccccccaactccgtcttggggcttggcccccgacgctgcttggagggaaggccggtgcccccaccctcgcccagtgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcagtgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccaggg

SEQ ID NO: 118398 - DNA, 6573 bp, Homo sapiens
  Payload ID: 3166
  Gene Symbol: C15orf59
  Gene Name: chromosome 15 open reading frame 59
  Uniprot ID: Q2T9L4
  ENST ID: ENST00000569673
  CDS Start-End: 1206-2087
gagccgtgggagcggtctcgcccagggccgaccgcggggctgggctgagcagaccctcgcggccgctccggacgccgcgggtgccggggcacggacgttctgggtccgggctgagcgcgtcccgggcgcccggcggtgccagctcactccgggcggggtagggcagggcagaccccagcggaacacggacccggccgatctggactggacagagcgaatcccggacggtgcagagcccggggaatgccgggcgtgggctgaggggatcccggcgccctcccagccctccgactttggctcacgcgctgggacctgcccggcgtctcctcggcctccccgcgccccggtcacctgtggcctcggagccccaaatctgccggaccctcgctcattcccgaccccgagcctggagaggcttgagaaagatttttcctgcccccttccctggagcgcggaggccccgccccctcccaccgcccagatgtctccggtcacggctcggaggacctccctgaggcccggggccgaagggtccagagagagaagcccgccctagggagccttgggggccccccaactccgtcttggggcttggcccccgacgctgcttggagggaaggccggtgcccccaccctcgggggctgccctcttccaatccagctccctccccagagctgcccatatccggagccccttccacatctggaagaccctggccaccatccctctgcaggtgtcagttgcatccagagacctctgcctttgcaactgcctaggagttgtgaggggatccctgctgccttcccccatcccaagggcatctcttacccttagtccctgcagagtcatccccctgcctctgtgttcaagctcaggcagagatcagctctgcacacccacaggcacttcaagacctggaggccactcctgggacccaaggtccctccccctcctctcctgtgtcctcaccttgaccccctctgctagactctgtctccctctgggtgtcccactctccacccagaggcagaggaggctgggtggcagggggcaggggctggttgagggccgcccagggccagggtgggctggggggccgttaaaatgtggagctctgcccagccgaggggggctccgtggaggcagacgcagtgtgtgcccagctggggggagtatgggcaggcctgcggccacgtggtaaacgatgaacattcggggcgccccggacctcgggcagcccagtgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcagtgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgctaaggatctggccccacaggccccaaagctttcacagagctcctcttagacatgaagatgcccattggcctcctaggtcccaggaggtgtgggcaggactgcccttcctccgttctcattgcggggctcctgaagggggtatctgaaagtatgtaaaactgatgggaggtctgatcctccttttgctagcccctgaactctgtggtggagtctggctgatggccagggccatgtcctagaggggactcccctgcaggaggcgggctctaaagggagtggtgtccctttaggccagggttcacagtcggggtggtctggagactgcaggactcagggcctgggggtggcatcagtctggccaggccctgcgtcacttgcacccaccatccttctactccaaggcagacttactcggctatacacagtcctgcctcacccccttccatcttagggttgcctgggacataggggaatggcaagctgctcccatggcgcaggcctccgtgctgggatgctgggcatccacagagcctgaaggatcgcctgggctgggcaggggtttgattggagggtctggaccacccccaatcctttcagctcccattctcagcctgattctgagaccaagaccaaaacctcagggcaaagcctcagccagtcctggcgtggccctaagcagacctgagatctgtgcgaggaagtaggcagccacttccatggggctaaaaattagggccgtagacaggctcctggccaccttcaccaggtgggcagccttggaaaggagcccagtggtccccactccgtcccgatgtctccacacccagcccctgagcccatctcagcaggtcctgaacaaagatgaggttacagcctagaggtaccagggcttcatctggggcatggccagcacagggacagcagctgaatatccttgggataataatgacaattatattgctcacatttattgagcaggtctctatgctacttctatgccgaatactttttatagcagcatctcatttaatcaccacaataacctgatgagacaggaagtattattaccccatttttctttttctttctttctttttttatttttattttttttatttttgagatggagtctcgctctgtcacccaggctggagtgcagtggggcgatcttggctcactgcaacctccacctgccaggttcaagcaattctcccacttcagcctccagagcaactgggactacaggcatgcgtcaccacgcctagctaatttttgtatttttagtagagacggggtttcaccatgttgggcaggctggtctgaactcctgacctcaagtgattcgtcagcctcagcctcccaaagtcccgggattacaggcgtgagccactgtgcccccacctatccccatttttcaaatgagatgactgaggttcaaagtagttcagtacctgccccaaagccacaaagcctgtgctactctgcccccaagaattagtgatttccaggctgtgcctggctctgctagctagcagctgtgtgaccttggcaagtccgtttgcctctctgagcctatctacctcctctgtataatgggtctggtagtcttcacctacctcaccagctgctgtggagctccgacgagatggtgactgtgaaagcacttgacaaactgaaggcactggacatgccttgtggtcagtgtggcctcaacccagatgtccagtgatttccagggcacaggggctttgagtgggatggccaaagaagacacctccatccaactgggagccacccctgggtcacaaacactccattgcttggtccctcgcagtagctcgaggtcagaagttgactgcagcttgattcacagcccctcgctcagagcagggaggtgggactggcagcacagcaaagacatcgctccttgggggcctccctgttgcatatttcaattaaggcaggtttacagccccccagcgtctgtccggagggggcctgagcagcaggcctggcagcacccactgctcctgcctgaagaggtgctatccagccccggctgtggacatacagtgagattgtacaggccggtctggagcagctgcaggggatatgatctggataagactgagcagacctaggaggctctgcaatgtagagcttattcctcaagctcatggtgagattggagccctaaagagttagccagggtgcagccaccagtgtggaaatccagggatggcgcaggccatggccagctcttcccagctcacgtctgagaaccaagggtctgagcccctctatcagccccaggaaatcctcagccatttggtgctgatcagcgatagggctctggttcacaggatgagtgccaggggctcctctggggagaggggccagctgcattccgccccaccctgagagtgagaagggggcagtccccgaccaggaatgggcctacctggtgctaagaatggacataacagttctccctctgaggcttgcatttcatctgtcatggcaagagcactttcaggctcacagtttctcatcttttcaacagtcagggaaaagaaacctatggaatagttcgcatttcacagaggaagaaactgagggccagagctaggggtctctgacacagccatgggatcctgcaccccacactggctctatgtgactctgtagtagtggctaatgtccatcagtcgccccctgctcccctgcctggccatttgcccccaaatagggcagtggtgggagtatatcctggaggagggggaagtgggatataggtagtacttggctgacttcacaattttgctacacccagtctggacctcctgacagtggagtgggatccctgtggcttcctttttcttgtttttgttttgttttgtttttttttagatggagtctccctctatcatccaggctggagtgcaatggtgcgatttcagctcactgcaacttccacctcccaggttcaaacaattctcctgtctcagccacctgagtagcttggactacaggcacccgccaccaccccagctactaagttttgtatttttagtagagatggggtttcaccacatggccaggatggtcttgatctcttgactttgtgatctgcccaccttggcctcgcaaagcactgggattacaggcgtgggccactacgcctggccaatttttttttgttttgtttttttgagatggagtcttgctccatctcccaggctggagagcaatggcgtgatctcagctcactgcaacctctgcctcctgggttcaagcgattctcctgcctcagcctcccaagtagctgggattacaggcacccaccatcatgcccgggttaatttttgtattttcttagagatggagtttcactatgttggccagcctcatctttgaactcctgacctccgatgatccacctgccttggcctcccaaagtgatgggattacaggcgtgagccaccgcacctggccccagtggcttcttcagacttgaaacacaaaatgtggccagctagggatagagagaattctgactttcaacactgctgagtcatggcatgggctgcttctgggtagtgagctccctgtccttggggtagacacagccatcccttgggtccttcctccagaccttccaggtacagccctttgctgctcttccctgcctccaaacctttgccagtttttgagtttctttacccaggatgttccatcagatctctctgcttccgggaagtcctattccactgaccacctactgtgtgcacaggcttgtgctgagtggtgctgtggaggggcagaagggagctggaacctggtgatggagagaagtcatagcatgatgaataactcatgtccactgggcacgtgctaggcactgggcattgttctaagtgtatgtcttatctcatttactcctcacagcacgtatgagataagcaatcttacttatgtctaagtagcttccagatgaggaaactgaggctctgggaagtgaagtaacttgcctaaggaaacacaggatgggctatggaaccaggattcaaccacaaacacagtgacttagcatcatctactgcaaacatccactgcagttaaaatgcctggagtgggtggcctggtcactggaggtgagggtcggggctgggtcgtctgagagccaggcgggtcttcggggtgaggggagtgttggggtgaggaaacatgtgaacatgcctcagtctttggagaacttagttactgttaacctgaatgtcaccacccctgactcggagactggcaccaaatggattatgggttcaataaatgtttgttgaatgaataaacgagccccatttgcagaagggta

SEQ ID NO: 118399 - DNA, 4253 bp, Homo sapiens
  Payload ID: 3167
  Gene Symbol: C15orf61
  Gene Name: chromosome 15 open reading frame 61
  Uniprot ID: A6NNL5
  ENST ID: ENST00000342683
  CDS Start-End: 182-655
cccatcccccggactccacccccagcgggaggccacggggccgctgtgcgcacgcgccgccgcacaccgggggctctcgggcacccgcgcggcgccggttggccttcccggcgctcgcccgggggcgcgcttgcgcgccagcggctgcggacaccagcctgcgtccccggcgcggcgggccatggaggccctgaggagggcccacgaggtcgcgctccgcctgctgctgtgtaggccgtgggcctcgcgcgccgccgcccgccccaagcccagcgcctcggaggtgctgacgcggcatctgctgcagcggcgcctgccgcactggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagtatctgcttctttaagatgaatcattgccctcaagaggtgaagctttttatacatcgttatatattacatactctgtttagctgatgtgaactacaaacacatgaagcttcacaccattttttccctagaactaggttaacctacagataaaaaatgattacaatgtaatagattctatagttaattaacaatttaaatcaactctgaagagaaaatatagatgcccacacaaaagagaaggggggaaaatcttttatgtaacaatggaaaaagaagtagaagacattaggatgtatgatggaaatattacatcattggcaaatccaaaattgatgagaatctaattgtaatctcaagtctaaaccattcagctgccaggattgtaaatagaaacgttttaaaggccttgtgccatttacctggaggaggggttggagtgtaatgttgaaacttcttgttgcttaaagagtccaaaaccatatcgtttgtaaaatgtaataataactggttaatataagtgtagcaaggtgaatgaaactcagacttattaaaagttaaaacagctttcctataaagctgtaagaacaattaagatcttctagaaagatgcagaaaaataaatttggtaactgtttataaaagcaattaactgaaatggtacatatccatagacttattggcaataaggagtgggctgaaattttaaagacctaatggcacttttgcatttgaattttattaacttaattgcatttttgaaagccaagtcatttaaaaaaatgtatccttggggtagtcacaaaatacccagatgaatggtaaatttcagacatttggagtaatttagggagaactaagtagaactatttaatttctaaaccaatgggtgtttaagatttatgatctctcccataattacaaacatacattatatatcattttatgttaatgtgttgctgatactctgcaacacttacacatttttgtagcaaaacattttataaaattcaacatttggatgcttatgtcaagtcagtagagaaagtgagtggaagtgactgaggtgaaggcaccagaataatgaagtaatacaaactagcttcgttaaaggtagtcattttaaatgatctacagagtgaactgttcttcaaatatatgtggtgttcacttgtctaaaagcaattctaagtaacactttaatcaaagaagtacttatgccaatatatttagtccagaagaatatacttgacactagttaaatgaatggcttacacaaaggagatagtgttacattaagcttcattaataataaaacaactggctattagcattttgcagggaaggctagaactgatttcctctgtaatgggcaaagttaaataactatagctcataagttttaagtcaaatactgctcattcattgctgctggtcttgtcaatagtggctgtaaaggtttggtcccaacacaaggctgataaaatggtctttaattaccagactataaatacagcttttcagtagagttgcacctcttttcacactggcctgtttgatttctgataatttgtactgctgactctgcttacctgtttttcaatagctatagtcagtgtgacttcttgcccatatgtgataggtaagtgtccttggagaacatctttgacaaactaccctattgatctctgtaattctctgctgcttgcagcattaaacagggccttgatttcttgtctgatgtgctcactgtataacaagtaaatgtaatattttcttgtattacatgaaaatcaatagacctcttgctcttacggagttgatcatggtgaaggatgaactaactcaacaatgggtaaaggcgtggtttaaaaatttaaatatcattcattggatttattaagtcttgtaaacttgtagtctgaaaacaatacttcccattgaacagcaatggtttaagttttttctttaaagctgcatattacaccaaagtattatggcctgaaagggagaaagtataaatgtgtaagtcaggagactgagtctatttttagtattggtgctgtcttactttttgacctcaggctaataactctcctcctttgtgtcttggtttttccacctgtaatctgagaagaacgaaacaagagacatttctacccgaaaatgtacatcaattttacttttgtctctgcaaaagctctgtttttataatccacattcttctgctccattatacttaaaggacttcattaattaaaaaatttcaaaaataaggtgatggagaaagaaggagagatgcattgatagcacatgcccactaaccctgaagtggcatgtggggagctgaagaggcccttctcttctgcatatcagtagttttcttaattggtgaaaccactgattagcttttctgtcatatttctttgacaggatttttatctttaatccaaccaaaactgttttaataaaggtgtacttttagtacaaaaccttgcatctcttctattgttatttctatacaaatgaattatcacgtattggaataaatttctaggcaaattcctaggcaaaattcttagttcctgtgtaagttgtgagccactataaagatgcagtaacctatttgggagcgtgagagaggctgctaatacaaaaatctctattttcttagtgttgatgtcctaaaatgccaaattgtagaaacagttatagtttaccacacattttggggcattaatatttttctaacgttgacttccgtaaaaattcaaacttttctttttgagaaggagtttcagtcttgttgtctaggctggagtgcaatggtgcgaccttggctcactgcaacctccacctcccaggtccaagcgattctcctgtctcagcctcctgagtagctgggattacaggtatgcaccaccacgccggctaattttgtattttctgtacagacggtttcaccatgttggtcaggctggtcttgaactcctgatctcaggtgatctgccggcctcggcctcccaaagtgctgggattacaggcatgagccaccaggcctagctgaaacatttgtaattattaaaaccgtgtatcttttaaagtacattttacttcatgtcatttatattcacccaaaactgtaagcatagaacatctatagttcttcatgaaatatcttttaactctgttaaagaatgatgtttgaataagtgggatgacataaaaggcaaagatcttggtttcactgcactgaaaagctaatgcagataacagaaaccttatcctaaagctagtggattaagtatctactgttactcaaacaataatgacatttgggggcatcttaacctaaacaagtacttagcattacatctcacctgggtcaacagtctagagtatcagagttaaactctgttactgtaaattaatggaaaatgtaactgcactttgctgaaagatcaatgtccaataaaggctgcacgatc

SEQ ID NO: 118400 - DNA, 769 bp, Homo sapiens
  Payload ID: 3167
  Gene Symbol: C15orf61
  Gene Name: chromosome 15 open reading frame 61
  ENST ID: ENST00000557807
  CDS Start-End: 494-676
cgcgggagtcagctctgcctcccggcgccggcttcgcctggggtcctttgtactcctcgcccagggggtccccagcttgctgagctcctggcacccgaagccgttcgcctgctgcgggcgcgtcctcgggcctagggaggggcgggtcgccctcctgtcctgcccatgttaaccagagtagacccctggcctgggcagtaagccagggggcgtcaggaaacgccccctagaaagtggctctgaagttgacatccgtcctactgcatggcaggactcattcccgtgaacatcactttgcagctgcgtttatgttgcaataactggaactactcttttaagtttcttttgttttctttgtatgaattcccggcaagttcgttttactaaaagcaccaaaggttttcaccagacataacagcttcctgaggtgctaggcctaaaagatttttaaagatctttaatatttgtatattttcatggagacgccctgaggatgtttactgtcactaggtgtttattttcttttggtttaatgacagaagagggaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaa

SEQ ID NO: 118401 - DNA, 2370 bp, Homo sapiens
  Payload ID: 3168
  Gene Symbol: C15orf62
  Gene Name: chromosome 15 open reading frame 62
  Uniprot ID: A8K5M9
  ENST ID: ENST00000344320
  CDS Start-End: 417-944
gagctcgggccatctgctgcctgcctgtggaaggagcgctcgccagcctcacccagcccgagaaggtccacctctgcctccgccggagctgccctcattctggctccagtaagtgctgcttcttcctcctgggtttttttccactaccctattcagtaaccaggccactcctgtccctgtgggaaactcttgctgccaggaactcccagctgtctgctctcctgggcaaaaaagttccttcttcctgagccctcctctcaccatccaagatgtggtcaaaggtctgtgctgagtggaaaccctgaggcctctgctcctaggggagcctccccagctgctggcactcactgccccagcagggaccacatgcaccctggctgctcctgaacacctgtctgctggctcccctgggccccatggagacctggcggaaaggctccttccgcaacgcctccttcttcaagcagctgagcctggggcggccacggcggctccggcgacagagtagtgtgcttagccaggccagcacagcaggtggggaccacgaggagtacagcaaccgagaagtcatccgggagctacaagggaggccagatggccggcgcctgccactgtggggggacgagcagccccgggccaccctgctggccccacccaagcccccacgcctctaccgagagagctcaagctgccccaacatcctggagcccccacctgcctacacagcagcctactctgccaccctgccatcggcgctctctctgtcgagtgccctccaccagcactcagagaagggccttgtggacactccctgcttccagaggacacctaccccagacctcagtgatcccttcctctccttcaaagtggacctggggatttcacttcttgaggaagttctgcagatgctaagggagcagtttcctagcgagcccagcttctaaatggggtgagggtgggcaaagccggggtgactggaagatccagaggctggggattaaggaaaggacagggacaggactccaggcccatcgctggagggttcaggcaggcagagcttcttcatcctgggggaggattccaggataggaatccagggctctgcctgctctctgggtcctggacagtccttccaggcaccccagagtggagggacagaggcaatctggaaatgttgggggggcggcccttcctggcaggaccctgaagaaagctggctatgccgggaaagggaggctgtgccgggaaagggaggctctgtgcggcactacaggaaccaggtagaggctggcagagccagaaggtggcacggggtcagatcagggagtgggaggacacagactgagcagaagagatgagtgccccatgccagcctctttggaagccactgtcaacagagagaggtcacaggacaagcttgggtaaaggcagtccaacccaggcagaagaggaaagtgggaaggcccaggaagaaaggggagaaggcctgaccctgtctaatctggtggccactcactgcatgacactgaattgaaataaataaaattaacagttcagttcctcagctgcaccgttattccagattccacattccaaatgcccggtggccacacatgattaatggctaccacactggtcagtgcagaatggacgtaaacatcgctgcacaaagttctaatggacagcgctgtctagaccatggcctggagccaccagcaaaggggaggcgcatacaggggctggccacataggaagagataggtagagatagagtataactcaggaaaaagaccaggcaaatccttagcagaaatgaggacgtggctcagtctgccaacacagctacccggagcaatccctggtgaaggaaggcagctctagagaatgccagccacaggcacgcgcacggcttgcaaaggggtactttggggaattcccagaattactagtgatgggagccctggcaggtttccttcctcgaagagaggagaactggatccagggatgggcattcaacagcgaagcggcacagctggtttccagaaccgtctcccgggattagacagttctgccgcctgaaccctccgacgatgggcctgccaaccaggccaagcccactgggtcaaagccacaggctgtgctacggccccaccccatggcctcaccagaacacagaaaccagagcccagcagcactggctgggccatgtgttggtggccccccgggactcgctaagagtagcaaaggggagagggaagctctgacacacaccatttctacgacctaaatcagtggcctccctctttcctcctcttgtgtataggtaccgagctgtggatacaggagagaatgaataaaattctaacacaa

SEQ ID NO: 118402 - DNA, 729 bp, Homo sapiens
  Payload ID: 3169
  Gene Symbol: C15orf65
  Gene Name: chromosome 15 open reading frame 65
  Uniprot ID: H3BRN8
  ENST ID: ENST00000569691
  CDS Start-End: 222-587
gttgcaacctccagaaagaattcgtggtttcacccgggaaaacagctccccggattaaacggataggtttacacatactgatccacccagctattcatcttctgtttgctgctttaattgggtgcggttaaaaggccacgtccctaggcgttcaccggctttcttgccatctgctgcatgaaaactgactttgccgaaaaaattaacaaagaagagcgaaaatgacagaccgcaaccgggataagaaaagtacttcaccttcaaattcagacacagaaatgaaatctgaacaactgcctccttgtgtgaaccctggcaatcctgtgttttcatgtatgttggatccaaagacactccagacagccacctcactatcaaaacctcaaatgattatgtataaaaccaattcaagtcattatggtgaatttctacctattccacagtttttcccctgcaattatactccaaaggagcaagtattttcaagccatatcagagcaactggattttatcaaaataacactctaaatactgcacctgacagaaccagaactcttgattttcctaatattcaacacactctatgaaaatatattcctttgtatattgaagagaaaatatactcgggaaaaatgagtgttaaatctaagggtagaatacctaataaagaagataaaaagttttgaatcaatttttaaaataagttaaataaagtatttcaactgataa

SEQ ID NO: 118403 - DNA, 604 bp, Homo sapiens
  Payload ID: 3170
  Gene Symbol: C16orf13
  Gene Name: chromosome 16 open reading frame 13
  Uniprot ID: Q96S19
  ENST ID: ENST00000397664
  CDS Start-End: 62-445
ccggccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcct

SEQ ID NO: 118404 - DNA, 726 bp, Homo sapiens
  Payload ID: 3170
  Gene Symbol: C16orf13
  Gene Name: chromosome 16 open reading frame 13
  Uniprot ID: Q96S19
  ENST ID: ENST00000397666
  CDS Start-End: 13-630
gttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccgg

SEQ ID NO: 118405 - DNA, 544 bp, Homo sapiens
  Payload ID: 3170
  Gene Symbol: C16orf13
  Gene Name: chromosome 16 open reading frame 13
  Uniprot ID: Q96S19
  ENST ID: ENST00000338401
  CDS Start-End: 53-376
gcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 118406 - DNA, 558 bp, Homo sapiens
  Payload ID: 3170
  Gene Symbol: C16orf13
  Gene Name: chromosome 16 open reading frame 13
  Uniprot ID: Q96S19
  ENST ID: ENST00000397665
  CDS Start-End: 1-558
atgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctag

SEQ ID NO: 118407 - DNA, 794 bp, Homo sapiens
  Payload ID: 3170
  Gene Symbol: C16orf13
  Gene Name: chromosome 16 open reading frame 13
  Uniprot ID: Q96S19
  ENST ID: ENST00000301686
  CDS Start-End: 13-627
gttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccgg

SEQ ID NO: 118408 - DNA, 755 bp, Homo sapiens
  Payload ID: 3170
  Gene Symbol: C16orf13
  Gene Name: chromosome 16 open reading frame 13
  ENST ID: ENST00000456420
  CDS Start-End: 1-531
ctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggggagggggtgccctttcattctccaaaccccagcctgcaagtctgtcccaggctctctgggaaataccccgaccttggtccagtgggctgtgtccccatgcccacagccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtg

SEQ ID NO: 118409 - DNA, 590 bp, Homo sapiens
  Payload ID: 3170
  Gene Symbol: C16orf13
  Gene Name: chromosome 16 open reading frame 13
  ENST ID: ENST00000568830
  CDS Start-End: 69-590
cggaagcccggccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggggctcttcagagcagcaggacacctgctcaaacccagggccctgctcatcacctacgggccctatgc

SEQ ID NO: 118410 - DNA, 499 bp, Homo sapiens
  Payload ID: 3170
  Gene Symbol: C16orf13
  Gene Name: chromosome 16 open reading frame 13
  ENST ID: ENST00000568773
  CDS Start-End: 1-488
ggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggaacccagaatgggggcttcgggacacagccctcctggaggacctgggaaaggccagtggcctgctcctggagaggatggtaggtgggggagcgggggcccaggcaacctctctaggggttgagggccgtcctc

SEQ ID NO: 118411 - DNA, 485 bp, Homo sapiens
  Payload ID: 3170
  Gene Symbol: C16orf13
  Gene Name: chromosome 16 open reading frame 13
  ENST ID: ENST00000565163
  CDS Start-End: 1-485
aaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggaacccagaatgggggcttcgggacacagccctcctggaggacctgggaaaggccagtggc

SEQ ID NO: 118412 - DNA, 518 bp, Homo sapiens
  Payload ID: 3170
  Gene Symbol: C16orf13
  Gene Name: chromosome 16 open reading frame 13
  ENST ID: ENST00000564039
  CDS Start-End: 1-402
gcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacgggggagggggtgccctttcattctccaaaccccagcctgcaagtctgtcccaggctctctgggaaataccccgaccttggtccagtgggctgtgtccccatgcccacagccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaaca

SEQ ID NO: 118413 - DNA, 588 bp, Homo sapiens
  Payload ID: 3170
  Gene Symbol: C16orf13
  Gene Name: chromosome 16 open reading frame 13
  ENST ID: ENST00000568077
  CDS Start-End: 42-353
gacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccc

SEQ ID NO: 118414 - DNA, 801 bp, Homo sapiens
  Payload ID: 3170
  Gene Symbol: C16orf13
  Gene Name: chromosome 16 open reading frame 13
  ENST ID: ENST00000614890
  CDS Start-End: 77-631
gtgccccgcggaagcccggccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggagccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggctt

SEQ ID NO: 118415 - DNA, 2404 bp, Homo sapiens
  Payload ID: 3171
  Gene Symbol: C16orf45
  Gene Name: chromosome 16 open reading frame 45
  Uniprot ID: Q96MC5
  ENST ID: ENST00000300006
  CDS Start-End: 360-974
atgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatca

SEQ ID NO: 118416 - DNA, 1865 bp, Homo sapiens
  Payload ID: 3171
  Gene Symbol: C16orf45
  Gene Name: chromosome 16 open reading frame 45
  Uniprot ID: Q96MC5
  ENST ID: ENST00000452191
  CDS Start-End: 57-620
taacaatcatagccaggatgtgaagcctgtcagtttcctcagccgcaaattcttccatgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaa

SEQ ID NO: 118417 - DNA, 737 bp, Homo sapiens
  Payload ID: 3171
  Gene Symbol: C16orf45
  Gene Name: chromosome 16 open reading frame 45
  ENST ID: ENST00000561813
  CDS Start-End: 87-353
tgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagcca

SEQ ID NO: 118418 - DNA, 497 bp, Homo sapiens
  Payload ID: 3171
  Gene Symbol: C16orf45
  Gene Name: chromosome 16 open reading frame 45
  ENST ID: ENST00000565857
  CDS Start-End: 1-346
gatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccaatgaggaagtagcagtaaatccattacccttttcaagcggaggttgcaagaggttgcaagcggaggcagaataaacacttgaaacagagaactggtaacacttcgggcactgaggttctcctttctaacagaaggggaaaattgaaggcaaaaggtcatatgtcttccttcacattcaagaagcagctatgagaaagagtagtttcacatacttctgactggttt

SEQ ID NO: 118419 - DNA, 865 bp, Homo sapiens
  Payload ID: 3171
  Gene Symbol: C16orf45
  Gene Name: chromosome 16 open reading frame 45
  ENST ID: ENST00000564389
  CDS Start-End: 1-527
atcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccatctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagca

SEQ ID NO: 118420 - DNA, 622 bp, Homo sapiens
  Payload ID: 3171
  Gene Symbol: C16orf45
  Gene Name: chromosome 16 open reading frame 45
  ENST ID: ENST00000570249
  CDS Start-End: 119-229
cagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagctagagtgcagtggcgtgatcacggctcacttcaacctccacctcctgggttcaagcgattgtcctgcctcagcctcctgagtagccggaattacagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggagg

SEQ ID NO: 118421 - DNA, 534 bp, Homo sapiens
  Payload ID: 3171
  Gene Symbol: C16orf45
  Gene Name: chromosome 16 open reading frame 45
  ENST ID: ENST00000561692
  CDS Start-End: 1-405
atgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtc

SEQ ID NO: 118422 - DNA, 1854 bp, Homo sapiens
  Payload ID: 3171
  Gene Symbol: C16orf45
  Gene Name: chromosome 16 open reading frame 45
  ENST ID: ENST00000566490
  CDS Start-End: 180-635
cctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaa

SEQ ID NO: 118423 - DNA, 1866 bp, Homo sapiens
  Payload ID: 3171
  Gene Symbol: C16orf45
  Gene Name: chromosome 16 open reading frame 45
  Uniprot ID: Q96MC5
  ENST ID: ENST00000610499
  CDS Start-End: 57-620
taacaatcatagccaggatctgaagcctgtcagtttcctcagccgcaaattcttccatgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggaccccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaa

SEQ ID NO: 118424 - DNA, 2405 bp, Homo sapiens
  Payload ID: 3171
  Gene Symbol: C16orf45
  Gene Name: chromosome 16 open reading frame 45
  Uniprot ID: Q96MC5
  ENST ID: ENST00000615273
  CDS Start-End: 360-974
atgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggaccccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatca

SEQ ID NO: 118425 - DNA, 865 bp, Homo sapiens; identical to SEQ ID NO: 118419
  Payload ID: 3171
  Gene Symbol: C16orf45
  Gene Name: chromosome 16 open reading frame 45
  ENST ID: ENST00000631695
  CDS Start-End: 1-527

SEQ ID NO: 118426 - DNA, 737 bp, Homo sapiens; identical to SEQ ID NO: 118417
  Payload ID: 3171
  Gene Symbol: C16orf45
  Gene Name: chromosome 16 open reading frame 45
  ENST ID: ENST00000633657
  CDS Start-End: 87-353

SEQ ID NO: 118427 - DNA, 497 bp, Homo sapiens; identical to SEQ ID NO: 118418
  Payload ID: 3171
  Gene Symbol: C16orf45
  Gene Name: chromosome 16 open reading frame 45
  ENST ID: ENST00000633982
  CDS Start-End: 1-346

SEQ ID NO: 118428 - DNA, 534 bp, Homo sapiens; identical to SEQ ID NO: 118421
  Payload ID: 3171
  Gene Symbol: C16orf45
  Gene Name: chromosome 16 open reading frame 45
  ENST ID: ENST00000632906
  CDS Start-End: 1-405

SEQ ID NO: 118429 - DNA, 1855 bp, Homo sapiens
  Payload ID: 3171
  Gene Symbol: C16orf45
  Gene Name: chromosome 16 open reading frame 45
  ENST ID: ENST00000631883
  CDS Start-End: 180-635
cctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggctcccgggcagagaagaaagcagagcccccacctagcaagcccacggtggccaagacggggctggcactgatcaaggattgttgcggggccacccagtgcaacatcatgtagcccccacgtggggtgccctgggccatggggaccccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaa

SEQ ID NO: 118430 - DNA, 1605 bp, Homo sapiens
  Payload ID: 3172
  Gene Symbol: C16orf46
  Gene Name: chromosome 16 open reading frame 46
  Uniprot ID: Q6P387
  ENST ID: ENST00000299578
  CDS Start-End: 237-1424
agcgtggtcgtaacccaaggcaacggcccatccggcagcgacctgagtagctcttgccagtaggccgggactagctgtctcggggccttccatccgcttggccccacaggaaaagaccccaatattctcttttagtagcggagcgtgttgatcctgcctgaagtacaccagtgttccgaaggtgcatctggtgatctgcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacagtgagcagagttatcattcctgtctctacccacaggatcctctgagcggttgcggtagaacccctgggaataagcaccgtttgagatgcagccatcctttctctttcttctctctcatttcccacccaccccccactctctctttctctcctccccgtcagtctgtctttactcttcttttcctccattttttttttgtagtacaactgaagaaaactgaacctca

SEQ ID NO: 118431 - DNA, 1857 bp, Homo sapiens
  Payload ID: 3172
  Gene Symbol: C16orf46
  Gene Name: chromosome 16 open reading frame 46
  Uniprot ID: Q6P387
  ENST ID: ENST00000378611
  CDS Start-End: 117-1283
ccggcagcgacctgagtagctcttgccagtaggccgggactagctgtctcggggccttccatccgcttggccccacagcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacacacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaagcagaagcagtaagaagacgccacgtttggagcaaggtcttatttacacctgccatggtcatcggctcgctcttttaggtctccccaacccggcccccaaaaagaggttatatgcagaggtaatataatatatgtacttttgaaaataacaaagtcaccgtggagataatttcaaaacaatttattttcattttcagatacattggactatttcactgatgttaaaaagagtatgacttgtttaaattttttgttgtttcttttttgcagcctaatgttctgtaatagtaacttgcttccaagtaaagtatgaaaagttagtggaggggccatggctgtggtctctgataggtcaaactatactattttggaatgcgtggagttagaacaaagtttttattttgttattaattagtaaagcaataaataaaattgtcttactaata

SEQ ID NO: 118432 - DNA, 479 bp, Homo sapiens
  Payload ID: 3172
  Gene Symbol: C16orf46
  Gene Name: chromosome 16 open reading frame 46
  ENST ID: ENST00000565253
  CDS Start-End: 278-479
gcgacagagcgagagtccctgcctcgttcgaaaggaagcgagagggagcgaaaggcagaggcactatgtgccggggcttccccagagcgggcggggtctggggaggggcggggcctgaggaggatccgttgggagcggaaccctttaagggaaaagaccccaatattctcttttagtagcggagcgtgttgatcctgcctgaagtacaccagtgttccgaaggtgcatctggtgatctgcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatggg

SEQ ID NO: 118433 - DNA, 1359 bp, Homo sapiens
  Payload ID: 3173
  Gene Symbol: C16orf52
  Gene Name: chromosome 16 open reading frame 52
  Uniprot ID: Q8NHV5
  ENST ID: ENST00000331057
  CDS Start-End: 94-210
gggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcggtctcaccttaatccagctcagttctgtgtacaaaccatggaggttattcattcaggtgaaataaatgggttacttctgccagattaatctgggaagaaacagagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaagtttgctgctgattcttccttgtgtggccttttgaggagcctcctggggaattggaggattaagacatgccactatgagaagattataggaaaaacaccaagactagaggactctgggttccttttatgcaaagtcaactcttctgggtcacagttacccagcaacaaaaataaagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactca

SEQ ID NO: 118434 - DNA, 4360 bp, Homo sapiens
  Payload ID: 3173
  Gene Symbol: C16orf52
  Gene Name: chromosome 16 open reading frame 52
  Uniprot ID: Q8NHV5
  ENST ID: ENST00000542527
  CDS Start-End: 94-597
gggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaatgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaa

SEQ ID NO: 118435 - DNA, 605 bp, Homo sapiens
  Payload ID: 3173
  Gene Symbol: C16orf52
  Gene Name: chromosome 16 open reading frame 52
  ENST ID: ENST00000562186
  CDS Start-End: 1-120
ctgaccatcatctcaggatgtctctttctggccgccgatatcttcgccatcgccagcatcgccaacccggactggatcaacaccggggagtctgcgggttcactttgtatgttaaactaagtattactacgttatgaactacagcagatgctgaagagtaggacttaggatgtgcttgaatgacccacgaagagataaatgagatttaagaactaaaggggtggtggtgaggaatattccctggacaggccaaacccactaaagtattcccaccatttgcatctccccaggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaatgatccttttctgtatggctgccctaatatttccaataggattttacatcaatgaagtcggaggtcaaccttataaattacccaacaacacagtagttgggt

SEQ ID NO: 118436 - DNA, 695 bp, Homo sapiens
  Payload ID: 3173
  Gene Symbol: C16orf52
  Gene Name: chromosome 16 open reading frame 52
  ENST ID: ENST00000562695
  CDS Start-End: 20-346
gggggagcggggcggggagatggataaactgaccatcatctcaggatgtctctttctggccgccgatatcttcgccatcgccagcatcgccaacccggactggatcaacaccggggagtctgcgggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaagtaagtaacctgtgcttactaaatttgtctagaaggcacccacccacactggtatttttatgaagataatcaagaatcagtaataaggacttcataatcatcaaagagcaccacttgtgtatggccgtgagatagactctacacagtcccatcatttcttcaaaactctttctgcaagaccaggacatccacaactttaatcactttgtatgaaatgctattttaatgaattttatttttgctcagattgtgacataagtgttccaggtttgtgactcagagttaccagtagcctgagtcttttcctcttcttgaagctattggtatcatctatcaaaataaagataagtatagaac

SEQ ID NO: 118437 - DNA, 1257 bp, Homo sapiens
  Payload ID: 3173
  Gene Symbol: C16orf52
  Gene Name: chromosome 16 open reading frame 52
  ENST ID: ENST00000569656
  CDS Start-End: 94-438
gggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaagtttgctgctgattcttccttgtgtggccttttgaggagcctcctggggaattggaggattaagacatgccactatgagaagattataggaaaaacaccaagactagaggactctgggttccttttatgcaaagtcaactcttctgggtcacagttacccagcaacaaaaataaagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactc

SEQ ID NO: 118438 - DNA, 951 bp, Homo sapiens
  Payload ID: 3173
  Gene Symbol: C16orf52
  Gene Name: chromosome 16 open reading frame 52
  ENST ID: ENST00000567004
  CDS Start-End: 8-280
ttgctaaatggggcaatcctgggagctgacggccgcggaacgggcaatgagaatacaaggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaagtaagtaacctgtgcttactaaatttgtctagaaggcacccacccacactggtatttttatgaagataatcaagaatcagtaataaggacttcataatcatcaaagagcaccacttgtgtatggccgtgagatagactctacacagtcccatcatttcttcaaaactctttctgcaagaccaggacatccacaactttaatcactttgtatgaaatgctattttaatgaattttatttttgctcagattgtgacataagtgttccaggtttgtgactcagagttaccagtagcctgagtcttttcctcttcttgaagctattggtatcatctatcaaaataaagataagtatagaacaaatacataaaaatataaattagatgaaggtggaaatattttttaatattgattttgagtttctgctgtatgttgtaaccattgaaaaatcaacacattttgttatttaataattgtttatcaatatttcttactccattaagctctgcccaagggtataagcttatatattacacattctcttgtactttgcaaaattggtttaatttcacaacacatcagagatttatctcaagttaaacagaagaaacaaaaatgcacaaagaaaagacatttctgcaattctgctttcgtgcttctttttctccaaagcaattttgca

SEQ ID NO: 118439 - DNA, 2585 bp, Homo sapiens
  Payload ID: 3174
  Gene Symbol: C16orf54
  Gene Name: chromosome 16 open reading frame 54
  Uniprot ID: Q6UWD8
  ENST ID: ENST00000329410
  CDS Start-End: 97-771
aggcggaccgccctgcaccctccaagcctgcacctcttagtccagcaccaggaagagtggctctaggagggagaggagcccagggactgacccaagatgccgttgactccagagccgccctctgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgagcccatgggcaccgcccgagagcgctctgaggactggtatggctctgcggtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacccgagcagaggccagaggccagcgtccagtttgggagcccccaggccaggaggcagcggccagggagcccggatcctgagtggggcctccagccacgggtcaccttggagcagatctcagctttctggaagcgtgaaggccggaccagtgtggggttctgaatccccagggttccccagagatccccgaggcaggccttgcctcagtgggaccggggaccccaggatccagcattaggattgagactgccccagcgaagatgcccttcccaggctccttccacctggagtccccctccccgggtctgggtggtggccaggctatgtggactaggggaagcccagcagtgcctctgctcagctacctgggctgtggctcagagacctgggggtggagccaatgccaggccagaagccttcaagatcgcatccagatgaagaacccaaggtactagatagtcaggaaatggcatcgaccagccacctccaccttctttcagtgtttaccgaagccaccaataccaaagagaacgggtcctgcggtgctgaacagcctcggtgtggcgatgacagctggcaggagatgacaggaatccagtttcccagagccacaaatcctgttctccttggccactcacccactgtgaggtcctctaggaaaatacacaaagagaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatggccaggggaaactgagtttcatccaatgtggagaggagcgttgtcctagagcagggcaactcccaaactgtgacctctgatcatcgtcccttccagcttgctggagtgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccaaactttgtcttttttttttttttttttttttttttgagacagaatctcaactctgtcacccagactggagtgcagtggcacaatctcaactcactacagcctcgaactcctaggctcaagcgatcctcccacctcaacctctagaatagctgggactgcaggtgcataccaccacgcccagctaatttttgtattttttttgtagagacacggtctcaccatactgcctgggcaggtttccaactcctgggctcaagtgatccagcagccttagcctcccaaaatgctgggattacaggtatgagcactgcacccggccacttttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctggctattttttttttttagagacagggtcttgctatgttgcccaggctggtctttaattcctgggctcgagagagccactcatccccatctctcagagtgttgggattacagccatgagccaccatgcccggccaaacttcagccttgaatattagtgattttgccatattagtttaccatctgtacaattatttgctttatatttttctttaaattggctcattattcacttaatgaaattattgcaacaggaatcttttgtatcacttctgtaaatggaaaaccagtctcatttgccatcaatagaaggtaaaacatgaaaataaatacaatgtaaacaaaa

SEQ ID NO: 118440 - DNA, 2793 bp, Homo sapiens
  Payload ID: 3175
  Gene Symbol: C16orf58
  Gene Name: chromosome 16 open reading frame 58
  Uniprot ID: Q96GQ5
  ENST ID: ENST00000327237
  CDS Start-End: 41-1447
accgtgcggcaggggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 118441 - DNA, 2471 bp, Homo sapiens
  Payload ID: 3175
  Gene Symbol: C16orf58
  Gene Name: chromosome 16 open reading frame 58
  Uniprot ID: Q96GQ5
  ENST ID: ENST00000430477
  CDS Start-End: 7-1413
ctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtattt

SEQ ID NO: 118442 - DNA, 1845 bp, Homo sapiens
  Payload ID: 3175
  Gene Symbol: C16orf58
  Gene Name: chromosome 16 open reading frame 58
  ENST ID: ENST00000567994
  CDS Start-End: 12-1283
aaaagctcggcatggctgacgacgcgggtttggagaccccgctgtgttccgagcagttcggctccggggaggcacggggctgccgcgccgccgcggacgggagcctgcagtgggagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcggg

SEQ ID NO: 118443 - DNA, 584 bp, Homo sapiens
  Payload ID: 3175
  Gene Symbol: C16orf58
  Gene Name: chromosome 16 open reading frame 58
  ENST ID: ENST00000565128
  CDS Start-End: 14-436
ccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcagattcaactggcatgctgggccgcatcgtctttgcctggtggaaaggtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaac

SEQ ID NO: 118444 - DNA, 2783 bp, Homo sapiens
  Payload ID: 3175
  Gene Symbol: C16orf58
  Gene Name: chromosome 16 open reading frame 58
  ENST ID: ENST00000570164
  CDS Start-End: 19-1419
gggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaattcttgctcggcaattgc

SEQ ID NO: 118445 - DNA, 636 bp, Homo sapiens
  Payload ID: 3175
  Gene Symbol: C16orf58
  Gene Name: chromosome 16 open reading frame 58
  ENST ID: ENST00000567578
  CDS Start-End: 12-419
aaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcct

SEQ ID NO: 118446 - DNA, 555 bp, Homo sapiens
  Payload ID: 3175
  Gene Symbol: C16orf58
  Gene Name: chromosome 16 open reading frame 58
  ENST ID: ENST00000564807
  CDS Start-End: 310-555
gaagtttcaaataaggagttgtcggttgggatcaaactgtggggatccaagaatgccaggctaagaaaccaggatattttattttctgataaaaagaggatgcttttttggcaaatttctgcttcggagtgaagatgctgcactagatgggaaggagaagaggagaaatggaaagaagaaaaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatg

SEQ ID NO: 118447 - DNA, 1662 bp, Homo sapiens
  Payload ID: 3176
  Gene Symbol: C16orf59
  Gene Name: chromosome 16 open reading frame 59
  Uniprot ID: Q7L2K0
  ENST ID: ENST00000361837
  CDS Start-End: 66-1367
cttccctcccggaaggggcgtggctcttcagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 118448 - DNA, 1911 bp, Homo sapiens
  Payload ID: 3176
  Gene Symbol: C16orf59
  Gene Name: chromosome 16 open reading frame 59
  ENST ID: ENST00000569496
  CDS Start-End: 60-1277
tcccggaaggggcgtggctcttcagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaag

SEQ ID NO: 118449 - DNA, 650 bp, Homo sapiens
  Payload ID: 3176
  Gene Symbol: C16orf59
  Gene Name: chromosome 16 open reading frame 59
  ENST ID: ENST00000568753
  CDS Start-End: 352-650
acttcggagctgtgggttgtcagtgccaccctccttaccctgcaggctctgagctgggggcctgccgcggggcccggcggccccctcgggtctgtttgggctgggccctgcctcctggccgtgcgacggctgcccgtgtctttgcagggaaccaactgggacccgggctttgaagccacctccagggccagaaactaatggagaggacccccttccaggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtag

SEQ ID NO: 118450 - DNA, 1709 bp, Homo sapiens
  Payload ID: 3176
  Gene Symbol: C16orf59
  Gene Name: chromosome 16 open reading frame 59
  Uniprot ID: Q7L2K0
  ENST ID: ENST00000483320
  CDS Start-End: 614-1414
atgctgccggcgggctgctcgcgccggtgaggcctgcgcggcaggagggggtgggaggatgcgggcgggccggtagccaggcgcggggcccgaggcccgacgctggccgaggtgctgagccgccggtgcgtcccccaggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 118451 - DNA, 907 bp, Homo sapiens
  Payload ID: 3176
  Gene Symbol: C16orf59
  Gene Name: chromosome 16 open reading frame 59
  ENST ID: ENST00000567489
  CDS Start-End: 52-907
ggggcgtggctcttcagaggcggcaaattgcaaggagacgccgccgccttcatgctgccggcgggctgctcgcgccgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagc

SEQ ID NO: 118452 - DNA, 1457 bp, Homo sapiens
  Payload ID: 3176
  Gene Symbol: C16orf59
  Gene Name: chromosome 16 open reading frame 59
  ENST ID: ENST00000565716
  CDS Start-End: 1-515
gaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 118453 - DNA, 1864 bp, Homo sapiens
  Payload ID: 3176
  Gene Symbol: C16orf59
  Gene Name: chromosome 16 open reading frame 59
  ENST ID: ENST00000563531
  CDS Start-End: 12-1229
ccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaaga

SEQ ID NO: 118454 - DNA, 3894 bp, Homo sapiens
  Payload ID: 3177
  Gene Symbol: C16orf62
  Gene Name: chromosome 16 open reading frame 62
  ENST ID: ENST00000251143
  CDS Start-End: 49-3207
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatttatgttcatgactgttcatttaattacttctgactgt

SEQ ID NO: 118455 - DNA, 3115 bp, Homo sapiens
  Payload ID: 3177
  Gene Symbol: C16orf62
  Gene Name: chromosome 16 open reading frame 62
  Uniprot ID: Q7Z3J2
  ENST ID: ENST00000417362
  CDS Start-End: 11-2902
gactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaa

SEQ ID NO: 118456 - DNA, 3353 bp, Homo sapiens
  Payload ID: 3177
  Gene Symbol: C16orf62
  Gene Name: chromosome 16 open reading frame 62
  ENST ID: ENST00000448695
  CDS Start-End: 262-2703
atgacggatttttggcatccttatctggactgcctttctttaggaataaacagatgatacagagcaaagtttgtaaatctcaaatgcagcggttaacctctttgaggctggcccactgggctcccaggggcagcttctaagtgggaaatgtttcgatggaattctggttacataaggaagttgctttgaaaatctgggatagttttctataatggaatcattcccttgtgtctttattcacgatgaagtgtagagtgaaagatgcctccactgggggtattggtgcacgagaaaagccacctgtgtgacgtaaattcattctgtttaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatt

SEQ ID NO: 118457 - DNA, 3855 bp, Homo sapiens
  Payload ID: 3177
  Gene Symbol: C16orf62
  Gene Name: chromosome 16 open reading frame 62
  ENST ID: ENST00000438132
  CDS Start-End: 49-3207
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagca

SEQ ID NO: 118458 - DNA, 520 bp, Homo sapiens
  Payload ID: 3177
  Gene Symbol: C16orf62
  Gene Name: chromosome 16 open reading frame 62
  ENST ID: ENST00000537186
  CDS Start-End: 11-133
gactgggaagatggccgtctttccttggcactccaggaataggaactacaaagctgaatttgcatcatgccgactggaggctgtaccattggagtttggggactatcaccctctgaaacccataactttgtgatcctgagtcatgtccatttgtcacaaaaactaagcatcccctgcagatggttaagtctctgctgcaaatgaaccatccattcaactaccagaatgggaggaaagtacccactggagtgtttcactggagagagttgtgggagttccgttttacctccagaaattttcctcacaggtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgta

SEQ ID NO: 118459 - DNA, 1300 bp, Homo sapiens
  Payload ID: 3177
  Gene Symbol: C16orf62
  Gene Name: chromosome 16 open reading frame 62
  ENST ID: ENST00000539322
  CDS Start-End: 49-870
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaagatggaggttacagtgagccgagatcgcgccaccgcactccagcgtggacgacagagcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacg

SEQ ID NO: 118460 - DNA, 3138 bp, Homo sapiens
  Payload ID: 3177
  Gene Symbol: C16orf62
  Gene Name: chromosome 16 open reading frame 62
  ENST ID: ENST00000542263
  CDS Start-End: 48-2927
tagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatgcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaag

SEQ ID NO: 118461 - DNA, 573 bp, Homo sapiens
  Payload ID: 3177
  Gene Symbol: C16orf62
  Gene Name: chromosome 16 open reading frame 62
  ENST ID: ENST00000567245
  CDS Start-End: 5-511
gaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattgcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcc

SEQ ID NO: 118462 - DNA, 570 bp, Homo sapiens
  Payload ID: 3177
  Gene Symbol: C16orf62
  Gene Name: chromosome 16 open reading frame 62
  ENST ID: ENST00000544670
  CDS Start-End: 285-570
aaaaccaggtactggctgaacctcagtttgcgtcttcgctccgccgccttctggagtcctttctgcccctagaggacgcaggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatgctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagg

SEQ ID NO: 118463 - DNA, 586 bp, Homo sapiens
  Payload ID: 3177
  Gene Symbol: C16orf62
  Gene Name: chromosome 16 open reading frame 62
  ENST ID: ENST00000563649
  CDS Start-End: 1-220
aatctgtttatgggatctgaaaaagggttcccaaaaggagctgttgaacttgactcagcaggattacgtgaaccgcatagaggagctcaaccaatcgctgaaggatgcctgggcctcagaccagaaagtgaaggctctaaaaatagtcatccaggttagctctagtgatcccccacccccacccagaatttcctatgtaaaattccactgtgagacttagagttttcaggggcctacctgcagggtcttactcttgttttctcatccctttctttttcatatacttcctgtgaaaagccatgattatgaatctgtgtttttatgagatggctaatcccagggttaccatgtgcagctgcacaggttgtgcactgcacaactccaggaagcactcttcaccctaggttacagaactgatgataccccatgtgttgtgcagtacattaaccatggtgcaacccctgacacatttatgatttgtacacactaaagattgagcaactttctttcgggattccttgaccgcattcgcttggtgtctttgggattaatgacgtgtccctaataaatgaatatttcagacata

SEQ ID NO: 118464 - DNA, 1841 bp, Homo sapiens
  Payload ID: 3177
  Gene Symbol: C16orf62
  Gene Name: chromosome 16 open reading frame 62
  ENST ID: ENST00000542027
  CDS Start-End: 1-349
cctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatgggtcttgatatgctgcctggaactgttactgccatctttgtactagccttgatgaagccaacactggagatgatggagagaatgcttccttggcgagctgttgaaccaggccctaatcaggccttcctgccacgtgagactgaactttctggccatcgaggcctgcctgggctgggatgtctgtaggaggcatgttcaggccaaacgatcgtgaaaatgtcccagtcagaacctgtattttgggatgcaaaaagctaggtgagtggaaagaaggtggtcacagatggtcacatgcgacttgggccactggacctggagctctttgaggcttgctgtagagtccaggcttggaaacgctgtccccacagccgatgaggcaacttcccgtgtcatctccacacgttcatctcctcctggcattcaatatccacctacagaagtcacctgggattctcttccttgtgataaaaaagaatctcatcagacacatccctggggctgggcacagtggctcacacctgtgatcccagctcttgggggctgaggcaggagcatgagttgagtccaggagtttgggactagcctggacaatatagtgagaccccatctctacaaaaaattttaaacactagctggttgttgtggtgcacacccacagtcccagctacttgggaggctgaggtgggaggatcacttaagctggataggtagtggttgcaacaagccgtgatatgccactacactccagcctgggtgacagagtgagagcctatctcaaaacacacacacacgtccctgggatctgccattgattcatttgcgggactaaccactcttcctaaaatgccttgttcagaatccagtcaaagcacaaaaatcctacctcagcacttagggccgaagggacaccagtggaaaaggcaggactggtttagaggcacatttcccagcagcagcagctcagtcacatgtgtttggtaacaactcagacacctctctgcctacagctgctctatgacaggggaaaggaaaaggaaggaaaaggagtttgcgattctccgttcctcattcactccactttttatcagagatgcagacttgtcataaaactttttcctccatctaaagacatttcaatccccaacgaggattctggtggaaattccctaaaggggacattcagagtggcgaatagtgaacttagggcttcgggtacaaaagtacaacaccctgcacttagtggctgggtgaccccaggcaattttattactttatccctgaacctcagttgcctcatctataagatggggctaataatagcacccatttcataattatgaagattaaatacattaaggaaaacactagtatgtccctagtacctgctaaacactcaacaaaagttaactgtacatactgatgtctcaaacagggacggaatgtttaacacagaaaacaggaggttttagcactcactcgttctcctggctcccgaaatatgagctgccctgccccagttcatccaagcccatcaatatagttgtcctcgtccttaatctccacaggtgttcaatgtgagccaactgtcagatggctttcatttgcacaactgaataaaccatttatgcctagtgttccattactggaacgctaagcttatgggagttatttatatctt

SEQ ID NO: 118465 - DNA, 3352 bp, Homo sapiens
  Payload ID: 3177
  Gene Symbol: C16orf62
  Gene Name: chromosome 16 open reading frame 62
  ENST ID: ENST00000543152
  CDS Start-End: 564-2702
atgacggatttttggcatccttatctggactgcctttctttaggaataaacagatgatacagagcaaagtttgtaaatctcaaatgcagcggttaacctctttgaggctggcccactgggctcccaggggcagcttctaagtgggaaatgtttcgatggaattctggttacataaggaagttgctttgaaaatctgggatagttttctataatggaatcattcccttgtgtctttattcacgatgaagtgtagagtgaaagatgcctccactgggggtattggtgcacgagaaaagccacctgtgtgacgtaaattcattctgtttaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccaggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaaggagcatt

SEQ ID NO: 118466 - DNA, 2501 bp, Homo sapiens
  Payload ID: 3177
  Gene Symbol: C16orf62
  Gene Name: chromosome 16 open reading frame 62
  ENST ID: ENST00000513947
  CDS Start-End: 5-1360
gaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggtaactgccaggtggcttcagtgtgacgctcacctcctgtatggtgacagcccctgcccactgtgccctttaacgttaatgggaccctttcataacagctatagcaatgttagtgctagccagcctttatagagggcttgccatggtggctggctctgtgctgagtgcttttctgagatagtctcattttgacagctgtggaaggggaatgtggtagctccagaggccatgtacctaagtgaggccacacagctagaaagcagtttggtggctgggtgtgctcatatctgtaatcccagcactttgcaaggccaaggtgggaggatcacttgattttaggagtttgagacgagctttggcaacatagcaaaactccatctctacaaaaaaatagaaaaaattagccagacacggtgatatatgcctatagtcccagctactcaggaggctgaggtgggaggaccacttgagccccagagttcaaggctacaatgagctgtgactgtactactgcactccagcctgagtgacagagcaagacactgtctcattaaaaaagaaacaaaaaggaagatggttggtgacttgatacaaacccatagaattgggctccagggccaacaagccttattgcgtcttcacttaaccttcatgtaccccttttgtgtttataataatccaataaagtctgtagagcaggtattttatggaaggaaaacaaaactcagatgcttaatttcttttataattttatttttcttttcttttttcttttttgccagttgaagtattgtcaggaattgaagtgacatcagaatcatagcagacacatattttctttcttttccaagactgagaagcagttttagtagaacaccaattcaaactgtcatgaagactgtgataggccgggcacggtggctcatgcctgtaatcccagcactttgggaggctgacgtgggtagttcacttcaggccagcagttcaagaccagcctggctaacatggatatataggtgtatatcaccatgcctggctaattttttgtatttttttgtagagatggagtttcactatgttgcccaggcctgtcttttgtaaagaccctgtctctacaaaaaatacaaaaattaactgtgcgtggtggtttgtgcctgtagtcccagctactcaggaggctgaggcagagaatcgcttgaacctgggaggcagaggtcgcagtgagccgagattgcaccactgtactccagcctgggcaacagagccagactgt

SEQ ID NO: 118467 - DNA, 552 bp, Homo sapiens
  Payload ID: 3177
  Gene Symbol: C16orf62
  Gene Name: chromosome 16 open reading frame 62
  ENST ID: ENST00000538552
  CDS Start-End: 266-552
agaggcagtggctaagaatgtcggccgcagggccagagtgcctgggttgaattctaactcttacatttgcttgctgtgtgccttggatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaag

SEQ ID NO: 118468 - DNA, 2865 bp, Homo sapiens
  Payload ID: 3178
  Gene Symbol: C16orf70
  Gene Name: chromosome 16 open reading frame 70
  Uniprot ID: Q9BSU1
  ENST ID: ENST00000219139
  CDS Start-End: 189-1457
aggtgaggtgaagtgaggtgaggtgtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaa

SEQ ID NO: 118469 - DNA, 1353 bp, Homo sapiens
  Payload ID: 3178
  Gene Symbol: C16orf70
  Gene Name: chromosome 16 open reading frame 70
  Uniprot ID: Q9BSU1
  ENST ID: ENST00000569600
  CDS Start-End: 85-1353
ttgcccccgctgccgcggctgctgcagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctag

SEQ ID NO: 118470 - DNA, 525 bp, Homo sapiens
  Payload ID: 3178
  Gene Symbol: C16orf70
  Gene Name: chromosome 16 open reading frame 70
  ENST ID: ENST00000566026
  CDS Start-End: 30-525
aggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgg

SEQ ID NO: 118471 - DNA, 768 bp, Homo sapiens
  Payload ID: 3178
  Gene Symbol: C16orf70
  Gene Name: chromosome 16 open reading frame 70
  ENST ID: ENST00000569914
  CDS Start-End: 101-768
gttgcccccgctgccgcggctgctgcaggtgaggtgaagtgagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcat

SEQ ID NO: 118472 - DNA, 1025 bp, Homo sapiens
  Payload ID: 3178
  Gene Symbol: C16orf70
  Gene Name: chromosome 16 open reading frame 70
  ENST ID: ENST00000563853
  CDS Start-End: 64-1025
cgtcgttgcccccgctgccgcggctgctgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacat

SEQ ID NO: 118473 - DNA, 519 bp, Homo sapiens
  Payload ID: 3178
  Gene Symbol: C16orf70
  Gene Name: chromosome 16 open reading frame 70
  ENST ID: ENST00000569277
  CDS Start-End: 1-295
ctccccaaacaacaccaacccatttggttccacattctgctttggtcttcagcgaatgatctttgaggtcatgcagaacaaccacattgcctcggtgaccctgtatggcccccccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaa

SEQ ID NO: 118474 - DNA, 2722 bp, Homo sapiens
  Payload ID: 3179
  Gene Symbol: C16orf71
  Gene Name: chromosome 16 open reading frame 71
  Uniprot ID: Q8IYS4
  ENST ID: ENST00000299320
  CDS Start-End: 479-2041
agttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaagctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaa

SEQ ID NO: 118475 - DNA, 549 bp, Homo sapiens
  Payload ID: 3179
  Gene Symbol: C16orf71
  Gene Name: chromosome 16 open reading frame 71
  ENST ID: ENST00000586724
  CDS Start-End: 81-549
atgcacacgtcccgcacccggaccttccgagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttca

SEQ ID NO: 118476 - DNA, 2564 bp, Homo sapiens
  Payload ID: 3179
  Gene Symbol: C16orf71
  Gene Name: chromosome 16 open reading frame 71
  ENST ID: ENST00000590191
  CDS Start-End: 271-1884
gcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgaggtctgtgggacacagaagagtatacgcctgtgtgtgtgcgatccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaaggtccggaggctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttca

SEQ ID NO: 118477 - DNA, 953 bp, Homo sapiens
  Payload ID: 3179
  Gene Symbol: C16orf71
  Gene Name: chromosome 16 open reading frame 71
  ENST ID: ENST00000619274
  CDS Start-End: 1-411
gacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaaggtctgaccttgaacactggagcccacgtgaatccccacaagcagcaccttcctgggcccctcagacacagagggctgcaggctggtcacagacagtcctgcagcccacacaagtcttccctgctggccccgccctaaacactcatgctgccagtccccaaaagacttcattcattcaacatatatgtgaccgcctgctacgtgccaggcgtgggccaggtcctagggacaaaggagaggcctccgcaccccaccccatgacccatacctcctcttccccacctccctgggccagcctgccttccttctccctcctcctccttcctgggggaaggaagccccaccttctgtgcgcagtcagctcctaagcacgctcccgcttcccctggcctccccatttaaaaagggaggcaaaggatgtcaccactgtcactacactcatggctttgctctgggaagtcctgcaaataaaatgaaagttctccaacccctccctatccactcgggccacaaaggcgaggggaggcaggtctgaggcagaggagccagggcaggtgcggcgcttccgcctctggtcccaaagcaaagactcccctgtgactgacagcccgtgttatgttaaatacattttgttggtttgtaattcaaatcccataaagcaggaggtagagagccaacca

SEQ ID NO: 118478 - DNA, 5953 bp, Homo sapiens
  Payload ID: 3180
  Gene Symbol: C16orf72
  Gene Name: chromosome 16 open reading frame 72
  Uniprot ID: Q14CZ0
  ENST ID: ENST00000327827
  CDS Start-End: 398-1225
agtcttggggtgggctccgcggtgcaggccgagctgcgcggagggctcggcgatcagcggcggcggcggcagtggggaggccgcagcgccatgggggggcgttagacaggctgcggcggccgaggcgaggggcggcagcggttatctggtccgcggcgaccttcggccgggcccgggggtgggaaggcctggggcgggggtcgtccctggttgcacggggccgcggggcggggctcgccggccgtcggggtgcaggaggcctgggccgctgaaaggagaaggcgccgtcggtcgccaggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgccgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtcttagtggtgcaatggctagtataagcgtgcgttcgagtaccccaggctctcctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattgcaaaggaaacatgaggccatcttcccttgttcactgtttaagacaagtgaattctatagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttttgggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcgtttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttaatattttttagagcaaaattgttggaaagcatttggctgaatctaaagacctgcagtcagattcttcaatgtggtttacccaactggagtagtgataaacaccttaatcataaaatgaataaaaacaaaaaaaccatggggcttgtctgcagttttgttttggtcatcacatctgaataactttttgatgcaatcaaatgaagtttaggcttttaaaaaagaattagctttctaaatgtttttttctaagggctactggaactcattaaactcgaataattgtggctttgggcctgaagatttccattcaacagtgaaaactggctaacttcctttatagtgagagggatggccaacatccaacccagagggctagtcagcctcagaggccagtgcaagacgccaagagatgattttgaaatggggccataagtttagaaaattatgaacagaatgattgagtttttggcctggctactacctctagtggtgactacgtcagcagattaatctcattgcattttactttatgtagtatgttgtaacctggtgcttcattcattagattggtgactgaggtatttagtcatggtgaggatgggaatcttcagagatacattctggatttgtggaataaagtgactagaaaggttcttccagagcaaccccttgtttaaagttataagtgtttatggtacctgctaccccttctggaaagttgtcggctttgatggtttagatgaccttaccccataaggccagcttctagcctccctttggaatatttgaggtgtgtgatgttttagtgggggcagcatttgagagacgagcaggcccgagcacccaggctggctgtcagaccgtgtgttgtgctgttgggtttgatgggatgagatatccagggttttacttcctataatgggatctgcaggctccttgtgaagttcagttagacagtagcctgtgacgtagcaagtcaagttttcgatggcccctcattttttttttatttagtgcttaaaaaaaagatttaaaacagcaaaaatcaagccacacagcagcttatagtatatacaggtcttttatacattagaagtaatatggtgaaatcttttttttttttttttttttttgtgatggagtttcactctctcacccaggctggagtgcagtggcacgatcttggctcaccacaacctctgcctcctgggttcaagcaattttcatgcctcagcctcccgagtagctggtattacaggtgcctgccaccacacctggctattttttgtatttttgttagatacggggtttcaaatatggtgaaatcttgtgacagaatagtattcccttgtacagataagccttgatgcaggttacagattttttataattagtaatgcagcagtggagtgttttctttttcttgttttttgagatggagtctctgtcgctggagtgcggtggtgcgatcccagctcaccgcaatctctgcctcccgggttcaagcgattctcctgcctataactacaggtgtgcgccaccacgcccagctaatttaattttgaatttttagtagagacgggatttcaccatgttggccaggccagtcttgaattcctgaccttaagtgatctgcccgccttggcctccccaagtgctgggattacaggcatgagacactgcgcctggcctatgttttaagtttctctatgacaaatttctgtagatgaactatctgggtcaaaaaaattcatctataaaatactgatgggtcttgccaaagtaccttctgcaaggtaccagttaatacttccatcagaaagtaagagcgcctgttcccttacatcgtagccagtgttgggtatttatacttcctttggcagaagtgacctttcagttttaatctgttttttacctgctcgtatgaaggaagactttttgcttgatatcacgtgggtttgaatgctgactctactaccaggtctgggaacctaggtaagtttgcctctctgggctgttttctcatctgtgaaataaatagaaaacatagaaaaataaattaaaaaatgtgaatgtta

SEQ ID NO: 118479 - DNA, 10359 bp, Homo sapiens
  Payload ID: 3180
  Gene Symbol: C16orf72
  Gene Name: chromosome 16 open reading frame 72
  ENST ID: ENST00000574285
  CDS Start-End: 1-451
cgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtaaagccgtttaaacatatttctttggaaaaatggttaagagggtgcctgtggacccatttttcacggttaggtttaggtccagatatactgttttttgtcttacagtaaacagcttgctctagaaatgtttaatagaatgtaagctaagaacttaatatgggcgatttctgtcagctaacctatcctagaaaatgtttttagaaagttagtttgagcttattggtgttaaaatgacatatctttctgcagtgttgattagaatttatcgctttacacttatgtgttgtacgtgtttttttcctcttctgaagtcaaagaggaagttcttgtgtcttaagaattctgttatatttctaatggtccatgacaggcaagtaaggtgggaaattgttgggttagttctcatgggacctgggacctcccttgacacctttcttacttggtttgctgtagatggtgggagaggatggatgtaagacttgaccttctgcctgtcgtccctcaggtcccttgcactttaagaggcaggaccagcagagtgcagccagtgggcaggtggatctctatctccccaggccagacctgtcataagaaggcactcttggctaagggattttagtattgctggagaaacccgggaaatgtagtcagtgataagtctgttgttgcttgttgctgtctaatacagacttccaaatagagctgggagagttaacctgtgtgacagcattgaatactgctgtaggaaaaaaagcaacagaataataagacttgcttgaaaccatgatggaaagatggatcacgcagatggctaagcaggtagaagtaattaggtcatgaatcctttttttcttttttttttttttttggagacggagtttcgctcttgtggcccaggctggagtgcattggcgcgatattggctcaccgcgacctctacctctgggttcaagcgattctcctgcctcagcctcccgagtagctgggattacaggcatgtgccaccacgccggctaattttttagagacagggtttcaccgtgttggtcaggctggtctcgaactcccaacctcaggtgatccgcccaccttggcctcccaaagtgttgggattacaggtgtgagccactgcgcctggccatgagtcttgttgaaagttaacatttttgggccatagtacaggtcatctaaaacaaagtaacctggtaaggtactaagaaatagtggcatataaagaaactttatagacgttgaatcattgagactttataatacctgtagagatcttgttctctctggcaaaccgtagttctttcctgaaaccccaatgttgttttttcccttgatagtgtttaggacaattaaaaacaaaaacatgaattgcaggaaagttcaggttgtgtggatgcagtactttaagactgcacactgttcctgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagtaaggcatatcaatttatggttatcaaataggtttttttttttttttttgagactgagtgtcgctctatagcccaggctggagtgtagtgctcactgcgacttccgcctcctgggttcaaatgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgca

SEQ ID NO: 118480 - DNA, 906 bp, Homo sapiens
  Payload ID: 3181
  Gene Symbol: C16orf74
  Gene Name: chromosome 16 open reading frame 74
  Uniprot ID: Q96GX8
  ENST ID: ENST00000284245
  CDS Start-End: 185-415
cgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 118481 - DNA, 744 bp, Homo sapiens
  Payload ID: 3181
  Gene Symbol: C16orf74
  Gene Name: chromosome 16 open reading frame 74
  ENST ID: ENST00000602675
  CDS Start-End: 164-253
gcagtgagcccaccaagaaggaagcggcctgcagaggtgccgacatggggcttaagatgtcctgcctgaaagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 118482 - DNA, 832 bp, Homo sapiens
  Payload ID: 3181
  Gene Symbol: C16orf74
  Gene Name: chromosome 16 open reading frame 74
  ENST ID: ENST00000602766
  CDS Start-End: 389-478
ggggcgggaccgcgggaggcgcgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaagacgccggttttcatctgtgatgcggggacagctgcgctccttgctgcgaggcgtcaggacccagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgccc

SEQ ID NO: 118483 - DNA, 1002 bp, Homo sapiens
  Payload ID: 3181
  Gene Symbol: C16orf74
  Gene Name: chromosome 16 open reading frame 74
  ENST ID: ENST00000602719
  CDS Start-End: 223-453
cgccgccctctaggagcggggcgggaccgcgggaggcgcgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacaggctggacaaatcaggacgcaaaccctcgtcagctttggaacacaaatatttgccagtgaagaaaacattccctcatcagtcaaaacccggacagtctggcacacacgtctgcagctgcctgagggagcttctactgtgggaggggccagatggcccacagctccccctcctccctgaacactgcaggctccttctcttcctacttcattttgaagataaagagacaggggttcagagttgtcacttgcccttggtcacatagcatccagagtgacctttgatttcttctcttcgagcatatctgtcttttctcttttgtttttatttttttttaatagagatggggtcttggcatgttgcctaggctgatctcaaactcctggcctcaagtgatccttctgcctcggcctcccaaagtgctgggattacaggcgtgcctggccaagagtatgtgtcttcacacatgaaagtaactcagcgaaaactccagatctgtaaataacaacttctaaggcagatacacaacagacacagctttgtgagcaggcctgtgagctttacggctttttttcaccttcccagtgaccctctatggggcttcagggagg

SEQ ID NO: 118484 - DNA, 1237 bp, Homo sapiens
  Payload ID: 3181
  Gene Symbol: C16orf74
  Gene Name: chromosome 16 open reading frame 74
  ENST ID: ENST00000602583
  CDS Start-End: 552-746
gcagccagatctgctgggacacctttcccaaggaagagcccgttgcactgggctttgaaggataagcaggagcttgttactcaggcagaggaagaaagagcatcccaggcggggggagcagcatatgcaaaggcacgaaggggccccaggagcctagggagtctggggaagtgtgagcactttggagagtggaggctggagcgctgtggagagtgggggctggtggccgggaatgaggctgcagctggctgggccacatggtaaaggctgacaactggacccagaggccaactagcctatgatcagcatttcccaaaatctgtttcccgactcatggttctgtgagatgtgacaagggctcctttttcattcctgagacgccggttttcatctgtgatgcggggacagctgcgctccttgctgcgaggcgtcaggacccaggtgatagtgaagggagggtggcgcccgcggttcccggcggccactgatgcctgtctctctgtcgtgtgtacgtgcgtgtgtgctccacgcctggcttctcaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 118485 - DNA, 761 bp, Homo sapiens
  Payload ID: 3181
  Gene Symbol: C16orf74
  Gene Name: chromosome 16 open reading frame 74
  ENST ID: ENST00000602914
  CDS Start-End: 199-285
gaccgcgggaggcgcgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaag

SEQ ID NO: 118486 - DNA, 1068 bp, Homo sapiens
  Payload ID: 3182
  Gene Symbol: C16orf78
  Gene Name: chromosome 16 open reading frame 78
  Uniprot ID: Q8WTQ4
  ENST ID: ENST00000299191
  CDS Start-End: 118-915
catctggaggccacaccctaccttctaagtcaccaggccatcaagtccagacaaagggatcgaaagagtgagacagtgccagccacctcccacccaagccactagcaagactccacaatgtcagagcaacaaatggacctgaaggatttaatgcccacaaagaggaaatacatgtggaagactgctgaagataggcgcatgtctgacctcacctgtgtgctggagtggctggagcggaggcaggggaagaagaaacaagctcccgagaagcaaaagcccaaagtggtgacagtccttaaacgaaataagaagaaggaagagaagaaaggcaaaggcctcatgacagcacggggagggaaccgcagggacacggagacttcccagcaggccttaggaaagagattcaggaaggacgccgcctcctaccgaagcctctatggagtggagcaaaaggggaaacacctcagcatggtccctggcagctacatcaaggatggccccaagaaatctgatacagacatcaaggatgcagtcgacccagagtccactcagcggccaaacccattccgtcgacaaagcattgtcttagatcccatgttacaggagggtacctttaacagccagagggcaaccttcataagagactggtccaacaagatgcctgacatggcttacgaacgcaagctaaagagcctcatggagaaaagcaccgaacctaagatggaaaccatgaggatgttgaagccagaggaggtgctgagctgccgatacctgaggttatccaaggagaacattcggaccttgctcaagttgtgcaaggatgcaggaatgaatgtggatatccacccccacatggtcgaagaggacatagatgctaaaaaggtgttcaccggaatacccagcatggccctctaaatagctcctctcgccaccaccttcaggctccttctgtcatgggacccttcacctccagatgccatcctctggcacactacaagtggtccttccaacttagtgcatccctttagaaagtaagcaatcagaaaacaagcctcggctgtgtgatca

SEQ ID NO: 118487 - DNA, 1267 bp, Homo sapiens
  Payload ID: 3183
  Gene Symbol: C16orf86
  Gene Name: chromosome 16 open reading frame 86
  Uniprot ID: Q6ZW13
  ENST ID: ENST00000403458
  CDS Start-End: 156-1109
agtttcggccgagggtgggctccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgaaaggcccagcgcctgcggccgctgtaccagtacgtcaactattgcaaccctgagctgaaccaggcagggaagggggacggggaggctgaggtggaggcagaggcagagctggccccggttcccgaggagggaggtgtggagcaactgcaggccttgctgcccttggcaggtgagctgggcccaggcctcgctttgccctgtcccagtccactagtgacccccacccatgccctggctcccctcggagaggaggctggagaggagcctgggggcttgcccagcttgggggtgagtgaccacaaggccgaggtggataagtcaacccaggtggacatcgacaagatgctgagtgtctgcactgctccacttgtccccccgctctctcctcagtacaagtgactgtcccgccccactggtggctcccctccttccacgcctgaatttggcttcaggcttcctgtgggcctaggccctctggtggcgggggcaaatttggcacctgcccccacttgggactttggtcttgctgaaaataaatatttttctttttcaaagac

SEQ ID NO: 118488 - DNA, 1314 bp, Homo sapiens
  Payload ID: 3183
  Gene Symbol: C16orf86
  Gene Name: chromosome 16 open reading frame 86
  ENST ID: ENST00000445068
  CDS Start-End: 135-305
ccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgaggtgttcagtgacggatccctatgtcctttgcccggccatggtgaccgatggcctgtgtgtcatctctagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgaaaggcccagcgcctgcggccgctgtaccagtacgtcaactattgcaaccctgagctgaaccaggcagggaagggggacggggaggctgaggtggaggcagaggcagagctggccccggttcccgaggagggaggtgtggagcaactgcaggccttgctgcccttggcaggtgagctgggcccaggcctcgctttgccctgtcccagtccactagtgacccccacccatgccctggctcccctcggagaggaggctggagaggagcctgggggcttgcccagcttgggggtgagtgaccacaaggccgaggtggataagtcaacccaggtggacatcgacaagatgctgagtgtctgcactgctccacttgtccccccgctctctcctcagtacaagtgactgtcccgccccactggtggctcccctccttccacgcctgaatttggcttcaggcttcctgtgggcctaggccctctggtggcgggggcaaatttggcacctgcccccacttgggactttggtcttgctgaaaataaatatttttctttttcaaaga

SEQ ID NO: 118489 - DNA, 677 bp, Homo sapiens
  Payload ID: 3183
  Gene Symbol: C16orf86
  Gene Name: chromosome 16 open reading frame 86
  ENST ID: ENST00000602365
  CDS Start-End: 82-677
cggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagccctctgccctgccctgggtctttgcaggaaaggcccagcgcct

SEQ ID NO: 118490 - DNA, 537 bp, Homo sapiens
  Payload ID: 3183
  Gene Symbol: C16orf86
  Gene Name: chromosome 16 open reading frame 86
  ENST ID: ENST00000602987
  CDS Start-End: 1-513
ggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgtgagtggcagtccctggactgttccttctccccctgcctgtggggcccgacatggcacaacctggcgctctagcctctgccctgccctgggtctttg

SEQ ID NO: 118491 - DNA, 1585 bp, Homo sapiens
  Payload ID: 3184
  Gene Symbol: C16orf87
  Gene Name: chromosome 16 open reading frame 87
  Uniprot ID: Q6PH81
  ENST ID: ENST00000285697
  CDS Start-End: 263-727
gatactctgggcgagctcgcgggcgggctgtgggtcgcgagccgccgtgggagcgcgtgtcgcggtccccaggagccgccggccgacgctccgccccgcccccttggcgcccaggtcccgcgcgagctcgcgcacgcgcgcgcgcgcacccgccagaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaa

SEQ ID NO: 118492 - DNA, 6640 bp, Homo sapiens
  Payload ID: 3184
  Gene Symbol: C16orf87
  Gene Name: chromosome 16 open reading frame 87
  Uniprot ID: Q6PH81
  ENST ID: ENST00000394806
  CDS Start-End: 14-295
aagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgataaaagttttttgttctggtgaagtttgtgaaatatatttaaattcttaatttttctagtgttaagtcataatcgtttatagttgatttatattaaatgcttttgcattttggcatatcaatttaatgattaacatattcaaacttggtaatcactccccttattttcagtcgctcttcccccaatctgtttagaaatccttttaaagccttcttacagaagatagtcatcagttagatttagcccccttttaagagaatctccctttcaattttagccgtaacattatcaatttcagacttcatcctgcatctcccatcacctcctcaaagaaaaaaggtcaacattttttcctactttatttaaatggtaaccagcagagggagcttaagaggtactctagataggataaagaattttcctaaggattccttttcctttaatccctgtatctatctgcaggtactactgcaactattttgtatgcattttatttatttatttaggagacagagtcttgctcggtcgcccaggctggagtgcagtggcactgtctcagctcactgcaacctctgcctcctgggttcaagtgattcttatgcctcagcctcctgagtagctgtgactagaggcgtgcgccaccacgcctggctgtttttttttttgtattttttagtacagatggggtctcagcatgttggccaggctggtctcaaattcctggccttaggtgatctgcccgccttggcctcccaaagtgctgggattacaggcatgagccactgcactcagccttgtgtgcgttttagagtcttaactagtagtttccccaataatgtaatgtgattttatctttgaaacatactgtaaggaaacttttgattttaagtaaaaaagcttaaaaatgattaatatctaaaaatgcttgtatacatatatatgtcctcagaaaaagcaagaacagcttgtggaataagcacgtctttaaggaattatcgatgtcagagtctatccatttaaagctgaagaccattacaggaaagtcatgttaaaatattcattggatatggtaaaggaggtactggtggctgggctggagcttgccgtatagaaaagtaattacttcagatctcataatgttaaattattggcttatttaaaaatttccgtggcagagaggcaaattaggtttcctctgtgacataacctatttaaccaatttttcaaaaaattgtactctatgagctttcttgttataaagctaaaaaatttaatttgtctaggcatgttgtaatggtcccagaaaatattactttgtcactggtgtcagagaaacctctgtcatcagcagatgtcctaagagtataattatagttctttacttaatccaaaatttgttctgctctgatatctataaatgatatgattattcaaaataccttgaaatgattccacaattagattaggtctgttgaagataacttattcttaaatatgagtaagattaaataaaagtagtttgagagttgttactccctgcctcaactccatggtattccaaaatgtttttgtgggcactttaatacttgtagtttgattttgtttgttagttttagaaatgaacatttcttagattttcatgggtattttttggctgtatttaaatgtaaatgatataaaagtaagggaaattgtgcaaattatttcttgtgtagtaatcagtggaagtgatcaaacagcttgaagcagtttatgatgagaaaatttaaaattgcaaatgacctgaaaatttagccagtctattcttatttctttaaatttcagaaatacttaagaaaaaaaaaaaaaaggtcagtatgacctctgagttgcttcctaaaagtaatcagatagtgttctccctcagataagatttcaaattgaaaagtatttgacttctttaactctagtaattgcacttgattctctaattctgatcattaaaatgacttggcaatatttaattttggcttgcctttcaatctgcatgtttgtcttaaatttagaaaaattaagctctttacttacttttatataaagtattaattggccaggcatggtggcttacacctgtaatcccaacactttgggaggccaaggcaggagagttgtttgaagccaggagtttgagaccagcctgggcaacatgatgagaccgcgtctctacaaaaagtaaaattagctgggtgtggtgcttccagctactaggcagctgaggctaaaggatcacttgagcccaggagttcgaggctgcagtgagtgatgatcttgccactgcactccagcctgggaggcagagcaagaaacaccctgtgtgaaaaaagtattgaatttgtttgattccactttcaaaatatgctctagatacaggtagtcattctgccaaattgtgttcttctctaaaacattttgtccgtcattctttgaaactcattcttaattatttccactttaccttctagtttggtttgatgccttatattcttgctagttaaaagcattttttccctagtattttctgtctttctagcctttaaggcatattgttgttaacaaatctcttatttaagttaattaaagttttttctgtgcagctgggttttttcttttactacatgacaagcttcatttttacatttggaagtacatgtatatatgtttatatatttttattctcaggatctattttctagggaactatttttttaaattattcttttgtgctgccttaacccatttattatagtttgaatattagtagtacttactactcaaagattacaactatactaataactatcctaacatacaaagcagactctccaggattaaaagtatgagacatataacagagtctggaatagaataattctttttaccccagtcaagtatttgccttttgcattattaaggaatctgttttgttcttttattgataatttctatatttttttctttgccttattgcactggttgggactttttgccttgatccagttgtaggggggaaacattcagtcattaagcattaaataactttgttgttgttgtgggcttgaaaaaataccctttagtagattgagggtagactcttttatttctgcttgttggaagttttctgtcaggaacagatgttgaattttgtcagatgctttttctgcataattgataggaccttttttctcccctttagaatgttcatatggtgaaacatactgatagcttttcttttcttttttttttgacacggagtctcactctgtcacccaggctggagtgcaatggtgcgatcttggctcactgcaccctctgcctcttgggttcaagcttccctcaccagcctcccaagtacctgggtatacaggtgtgcatcaccatgcccggctaatttttgaatttttagtagagataggtttttaccatgttggccaggctggtcttcaactcctgactcagcctcccaaagtgttgggattacagtctcgctctgtcgcccaggctggagggcagtggtgtgatcttggctcaatgcaaccttgcaacctctgcctcccgagttcaagcgattctcctgccttagcctcctgagtagctggaattacaggcgcacgccactacacccagcttctttttgtatttttagtagagatggagtttcaccatgttggccaagctggtctcgaactcctgagctccggtgatccacccgcctttacaggcatgagccaccgtgcccggctgcatttctcttttgtaagaacctgctctggtttattgatattttgctgtttttctgttttaagtttcattaatttctgatctttagtattttctcctttctttgctttgggcttatttgctcccttttctagcttattgtggcggaagctcagatcattgattttaaaatttacttatttatttatttatttatttaattcaacactgatcagaaggctttttgtgcttttctaaaaaaagcatttaatgctataaatttcccatttgctttatctcacaaattttattgtgttgtaattttgtgttcaatttagaatattctgatttttcttggtattactataattttcaaatatttagagtttttttcagttatctttctgttactgattgtaatttattgttttttaaaattatagttctttgaatagttttgcagtatttgctctagggattactataaacatacttcactttttacagttcacttagaagtcaatattttaccagttcaagtggaatgtagaaaaatcttaccactgtttacattcctttaccctctcccctttatgttataattttcttataaatcataagacttggctgggcacagtggctcacctgtaatcccaggactgggaggccgaggcgagcagattgcttaagtccaggagttcgagaccagcctggacaatgtggtgaaaccccaactctacaaaaaatacacaaaattagctaggcgtggtagcatgttcctgtagtcccagctactcaggaggctgaagtgggaggattacttgagcccaggaggcagaggttgcagtgagccaagatcactccactccactccagcctgagtgacagagctagacactgtgtctcaaaaaataaaaataaaaaataagactcatcagataatgtattttttccttacaactatcatagatatttttaagaacccaagaggaaaacagtctatcacatttaccacaatatttatcatttgtattaatcttccttaattcttgatgttccaagtttacataggtatcagtccttttcatctggaaaatttcttttagtgcaggtctgttgacatttaattctcttattttttcttcatctgagaatgtctttattttgccttaattcatgaaagatatttttgctggatataaactactgtgttgacagttctttcagcctccatggtttctgatgagaaatgtgcagccattaaagtaatatttcccctgtatgaaacatgttatttttctctgagtattttcaggaatctttgtctttggtttttattggtttgattatgatgtgcccgggtgtttgaatttattctctttgggatttgttgagcttaaatgtgtaagtttatgcctttcatcagattatgtaaagttttaaaccattcagatattttctgctctactttctcctccctcttaggctccagtgatgcaagtgttagactctttggtattatctcacagatctcagaacctctgttcatttattttattttaataaatcatttcagttaacaaaatcatatattgtatgcagcatgatgtttcaatatgtatgttcacattgtaggatgtctaaagtaaagataatgaacata

SEQ ID NO: 118493 - DNA, 879 bp, Homo sapiens
  Payload ID: 3184
  Gene Symbol: C16orf87
  Gene Name: chromosome 16 open reading frame 87
  ENST ID: ENST00000565112
  CDS Start-End: 1-485
cgggcgcgcgggcgggcggcagtggcttggcggccgttgtctgtggaggggggcctcgccgggctcccggaggccgagcggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagggtgcagaaaacctatgccgaggactcctattttagaagggaaactaggtaaagaaaagtcagcagagaaaaaggaaaagagagaaatactgcctggctcagaaaacaacattcttttcagttgaaatagagggaatgcagctgaaagaagagaatgcttctggtgagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatata

SEQ ID NO: 118494 - DNA, 1872 bp, Homo sapiens
  Payload ID: 3185
  Gene Symbol: C16orf89
  Gene Name: chromosome 16 open reading frame 89
  Uniprot ID: Q6UX73
  ENST ID: ENST00000315997
  CDS Start-End: 203-1411
ccgtcatccccctgcagccacccttcccagagtcctttgcccaggccaccccaggcttcttggcagccctgccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 118495 - DNA, 1829 bp, Homo sapiens
  Payload ID: 3185
  Gene Symbol: C16orf89
  Gene Name: chromosome 16 open reading frame 89
  ENST ID: ENST00000474471
  CDS Start-End: 64-1368
agtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacaatgtaactgggcatcctgtattttacctgccactgtgtgacagtttcctgcccccaaaggctgccccagtgacggagctctacacagatggaccagtcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 118496 - DNA, 1444 bp, Homo sapiens
  Payload ID: 3185
  Gene Symbol: C16orf89
  Gene Name: chromosome 16 open reading frame 89
  Uniprot ID: Q6UX73
  ENST ID: ENST00000472572
  CDS Start-End: 133-1218
gccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcaaggccagggtaggtgggggccgggagggacccaggtgtgaacggatgaataaagttcaactgcaactga

SEQ ID NO: 118497 - DNA, 929 bp, Homo sapiens
  Payload ID: 3186
  Gene Symbol: C16orf90
  Gene Name: chromosome 16 open reading frame 90
  ENST ID: ENST00000399645
  CDS Start-End: 1-574
agagcagggccctgctgcacccaagtcctggttgctcctccccaccacactggccctccatggaagccttgatgcagtgagccaggcccaaggacgccccggccaccctgacgcaccccccaacatctacgaggggggcctggggtccccgcagccgcagtgccccagtgcccagggaagcaagcccaagaacttccggctgcgccacctccggggcctgggcctctacctggagagccacccgccacccactggccagtgtgagagccactggctgggccggcttatggctgggggctgcctgccacagcctgagggcacagcctgggccctggacctgccacaggggactctgggcccacgtaacagcctctgttcagcccttctggaagcccgattgcccagggacagcctgggaagcagtgcttccagttccagcatggacccagacaagggtgccctcccccagcctagtccttctaggctcaggcccaagaggtcctgggggacctgggaagaggccatgtgtcccttgtgcaagagaacccgctctggggccctggagaggccatagggatcccgagtgccaggactgggtacaggaggggcaggatggccgaggaggcagcctgagcaggaggggctcggcccccggcagtggccctgccacatggggtggcccaggcagcggcccagcgcccaggcctgggcctcgggagaatgtgatggggagagggaggaggaggaggttccgagggaggggcagaagcaatagaagcatggccgtgcccttgcagcctgcttagactccagtcagccacttgtacctgggaggccgggctgagtgcagaatcaggcccccccgccaccgcctccctgagaggccggggagcccacagctctgatctcaataaaagccaaggcctgca

SEQ ID NO: 118498 - DNA, 907 bp, Homo sapiens
  Payload ID: 3186
  Gene Symbol: C16orf90
  Gene Name: chromosome 16 open reading frame 90
  Uniprot ID: A8MZG2
  ENST ID: ENST00000437192
  CDS Start-End: 4-552
tccatggaagccttggtctgtgcattttctgagctgcacataagagaagatgcagtgagccaggcccaaggacgccccggccaccctgacgcaccccccaacatctacgaggggggcctggggtccccgcagccgcagtgccccagtgcccagggaagcaagcccaagaacttccggctgcgccacctccggggcctgggcctctacctggagagccacccgccacccactggccagtgtgagagccactggctgggccggcttatggctgggggctgcctgccacagcctgagggcacagcctgggccctggacctgccacaggggactctgggcccacgtaacagcctctgttcagcccttctggaagcccgattgcccagggacagcctgggaagcagtgcttccagttccagcatggacccagacaagggtgccctcccccagcctagtccttctaggctcaggcccaagaggtcctgggggacctgggaagaggccatgtgtcccttgtgcaagagaacccgctctggggccctggagaggccatagggatcccgagtgccaggactgggtacaggaggggcaggatggccgaggaggcagcctgagcaggaggggctcggcccccggcagtggccctgccacatggggtggcccaggcagcggcccagcgcccaggcctgggcctcgggagaatgtgatggggagagggaggaggaggaggttccgagggaggggcagaagcaatagaagcatggccgtgcccttgcagcctgcttagactccagtcagccacttgtacctgggaggccgggctgagtgcagaatcaggcccccccgccaccgcctccctgagaggccggggagcccacagctctgatctcaataaaagccaaggcctgca

SEQ ID NO: 118499 - DNA, 978 bp, Homo sapiens
  Payload ID: 3187
  Gene Symbol: C16orf91
  Gene Name: chromosome 16 open reading frame 91
  Uniprot ID: Q4G0I0
  ENST ID: ENST00000442039
  CDS Start-End: 78-476
cccggtttccggtttccggcgacggaagtgacgctatcacggcgcgccaaggcgtcagtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatgggattagatga

SEQ ID NO: 118500 - DNA, 1005 bp, Homo sapiens
  Payload ID: 3187
  Gene Symbol: C16orf91
  Gene Name: chromosome 16 open reading frame 91
  ENST ID: ENST00000563974
  CDS Start-End: 314-511
cgccaaggcgtcagtcgaggagtcaaggcagcaatgaatcgtgtcttgtgtgccccggcggccgggtgagctcctcaaggtctcggagggccgagggcagacaccggcgggcgggcggagcgcttactgctctctctcttccagggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatggga

SEQ ID NO: 118501 - DNA, 895 bp, Homo sapiens
  Payload ID: 3188
  Gene Symbol: C16orf92
  Gene Name: chromosome 16 open reading frame 92
  Uniprot ID: Q96LL3
  ENST ID: ENST00000300575
  CDS Start-End: 22-420
aggagtcatgaggctgtggccatgggtgctggtgtgggtgtggctggctgcactaggggccatagaaactgggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggttccagccccgggctcttccatcacatcctggtgggcttgctggtggtggcgttcttctttctccttttccagttctgcacccacataaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctc

SEQ ID NO: 118502 - DNA, 462 bp, Homo sapiens
  Payload ID: 3188
  Gene Symbol: C16orf92
  Gene Name: chromosome 16 open reading frame 92
  ENST ID: ENST00000569198
  CDS Start-End: 1-345
gcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggttccagccccgggctcttccatcacatcctggtgggcttgctggtggtggcgttcttctttctccttttccagttctgcacccacattatagtcgggggaaaagaaaagaccagaagatgcccacagaccaaaaggcacagatacagtgccaaaataagcccaggacaggcagccaagcgttaaggggaaaatgcagagcaaaaggagccaaggacaaagaaagttccatgtacttggagagtaaacaaaaacgagaaatggatgaatagacaagacagcatttttcttctggagtcagca

SEQ ID NO: 118503 - DNA, 413 bp, Homo sapiens
  Payload ID: 3188
  Gene Symbol: C16orf92
  Gene Name: chromosome 16 open reading frame 92
  ENST ID: ENST00000561910
  CDS Start-End: 22-141
aggagtcatgaggctgtggccatgggtgctggtgtgggtgtggctggctgcactaggggccatagaaactgcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggttccagccccgggctcttccatcacatcctggtgggcttgctggtggtggcgttcttctttctccttttccagttctgcacccacataaacttccagaaaggggcctaaagagccggacaagggctctggactcaacctgagcacccacacccacctcctctcctgttgatgagcaaaagtt

SEQ ID NO: 118504 - DNA, 233 bp, Homo sapiens
  Payload ID: 3188
  Gene Symbol: C16orf92
  Gene Name: chromosome 16 open reading frame 92
  ENST ID: ENST00000567847
  CDS Start-End: 1-150
tcagccctggggacagagtctccgcgcttcttagacagacctgacttcttcgattatccggactcagaccaagccaggctgctggctgtggcccagtttattggagagaaacccatcgtgttcattaactcagggacagccaagcgttaaggggaaaatgcagagcaaaaggagccaaggacaaagaaagttccatgtacttggagagtaaacaaaaacgagaaatggatgaa

SEQ ID NO: 118505 - DNA, 953 bp, Homo sapiens
  Payload ID: 3189
  Gene Symbol: C16orf95
  Gene Name: chromosome 16 open reading frame 95
  Uniprot ID: Q9H693
  ENST ID: ENST00000253461
  CDS Start-End: 175-651
agcgggacgggcgggcgcgcgggcgttgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaa

SEQ ID NO: 118506 - DNA, 1031 bp, Homo sapiens
  Payload ID: 3189
  Gene Symbol: C16orf95
  Gene Name: chromosome 16 open reading frame 95
  ENST ID: ENST00000567970
  CDS Start-End: 139-858
ctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagagtcaaaagacggttcaatttcctatcccccaaaccgccaagatgtgcccctgcctatgccaccgctttgggggccgcctcccgatgcctagggaccaggcagtgatgccctactgggtgccccaggtcctgaggtctcagcagcagatagtcaggaggcagcagagtttgaaaggcatccaagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagca

SEQ ID NO: 118507 - DNA, 974 bp, Homo sapiens
  Payload ID: 3189
  Gene Symbol: C16orf95
  Gene Name: chromosome 16 open reading frame 95
  ENST ID: ENST00000618367
  CDS Start-End: 228-659
agtcagcgggacgggcgggcgcgcgggcgttgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggcaagaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactctaaactggccacctctt

SEQ ID NO: 118508 - DNA, 3823 bp, Homo sapiens
  Payload ID: 3190
  Gene Symbol: C16orf96
  Gene Name: chromosome 16 open reading frame 96
  Uniprot ID: A6NNT2
  ENST ID: ENST00000444310
  CDS Start-End: 1-3426
atgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaagtcaatgcagaccctgcaggacttgctcactgatcttcatgcactccaggtcaccatcacagccctcagaaaagaagtggacatgctgaagaacatgcttgacaaggtacacccagaaagaatggacatctttgctgaagacttcaaaatacagaactggaagatggttgcactgcagcgggaagtggcttctctccagaataagtttaaaaccatccccaaaaccgaggacatggtgctctggagtggccttcatgatgccatgttcacctcagaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaagactctccaggctcaaatcaaaagactggaaatgaacaaggtgaataagagcacgatggaggaggagctgagagagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaagttagtccacagtgatctggatcccttgaagaaagaaatggaagaggtctggaaaatcgtccggaagctgctgattgagggcttaagactggatcctgacagtgctgctggctttaggaggaagctgttcaagcgcgtgaagtgcatctcctgtgaccggcctgtggagatgatgactggcccacagctgatcaccatccgcaaagcccacctgctgtcccggctgcggccagccagcgccaacagctgcgagtacttgcagcggcaacagatgagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgccgaggtggacatcctgggcgtggatgggatcctgtacaaaggccgcgtgaacagccagcgtggggctcagcccttggccgtcgcaaaggagctggcagctgtgaaggctccatctcccccgtcacaaagcctgtatgaccgtgtgcactccagtgccctatttggcgccatctgcccccccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtgagccccaccccgctgcgccccccatcgccaagtcccctccacgtccgaggctgaggcccatgtggccctcccactcccaccaagtcccctccacatcggaggctgaggcctatgtggccccccacccccacccccaccaagtcccctccatgtccgaggctgaggctcatgcgcccccccccatccctaccaagtcccctccacgtccgaggctgagacccatatgccccccccacccccaccaagtcccgtccccggctgagacccagggccctgagcctggcccagaaagggtgctggggccctggatagaggggaggggtctgtgtaggggacccccatgctgacccagtggctgttttatcctgtgcatataaatacaaacagcacagtgcaca

SEQ ID NO: 118509 - DNA, 357 bp, Homo sapiens
  Payload ID: 3191
  Gene Symbol: C17orf100
  Gene Name: chromosome 17 open reading frame 100
  ENST ID: ENST00000624159
  CDS Start-End: 1-357
atggcctcagcccgaggggccaagcagtcttcgccccgggtggggaccacccgctacacagagacgtccacggtccgcgtggagacctcgtcccaccgcgtggagacgtcgtcccggcgggtggagacctcccagcgccgcagcgaggggccctccctctccccctcggggaagcggctccctcgcatcctcgaggcgtcctcccggcacgtggaatcctcctcgcagcgcacggaaacgacctcccgccacgtcagagcctcgtccctgagggtggagacgtctctgcactgcgcggagagcccgaccccgcgggccaagccggccgcccgccagaacgaaaaaacggcccgatga

SEQ ID NO: 118510 - DNA, 4604 bp, Homo sapiens
  Payload ID: 3192
  Gene Symbol: C17orf104
  Gene Name: chromosome 17 open reading frame 104
  Uniprot ID: A2RUB1
  ENST ID: ENST00000409122
  CDS Start-End: 143-3001
tggctccaggcagcgcccgggcggcggaggcggctgcggagacggcggggtgcgggctgagggagccgggcctggacgccccccccatcacccccgtaccccaggagctgtgcctagtccaggagaggctggggggcgccccatggaggtgagacgcggagacacctgcccgcgccctcacccctcaggcctgagggaggaaggacttgagcccaaagtcgcgttccccggaggtgcgaatcgctgttggaacctcggcgccgacgccggcagcaggttaaccgacgtcttcggcagcgtgatgttgactggctccgcttccttctacgattgctacacatcgcagagtgaagacaatgtagacctaaggcagacctatactccattttcttcaacagaatattcaagttctgtagattcttcacttttctgtgcaccatggtctacttatggagatgacattaaacaaccttctaattctcagatcagtataaagaacaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtggtaaagcctttacaagatacagtaaactgtgaagataaagtccatgaaagcataaatagtagcaatccaatgaaccagagaggtgaaacaaacaaacattaaggaaatgccagcagaaagaagaataaaaagctgataaatataccaagacatgctaaaaatgttttaatgaacttgtcaaactttcagtatgttttctttcagatttaaagttaataccagtaccttaatgaagtctaacttctatttaaaaatcttctatttgaagtgaatccgatatagttttaagtaaacgcaaaggtacagttgactactcagagttctgagtagtcagataacaagtttaagtaaattaaatatttcctaacagctaaaatgtgcttaaactcattctgccatgcaggtaaatgcaaatgtgaaattcttctaggagataaatttcatttaggtttgtcttagttaagtataattccaaataatgaatctaagtgactgtaacccaattacggctacagcctagtaaccaagacaagttttgattgtgatatcaaagtgttttccttacaaaactggataatacctgggaaacaaaggaaaatacggataaacccaatattcatgtacaaacttaatatttaaaatactatactaccatatttataaatttggaatcttaatgcctaggtatatggagggaaatgcatctgattctcctaaattaatgataaaagtgtcagtgtaaaaaccatgcaagttactgaatataaaacctattcagatcatttgtgtatattctttaaattttaattatattatcaattgttaaatgtttccaattttaaagttatttaaattgaatcacaaaacattccctttatctggatcttttagacttgatgcacagtaactgaaataatgactactgttttaatacccttagtttgctgccttttatgagggtgtcacgaagttctaaaatgtatttttttaaaggttaatctctaactagtttagcttgcaattggttagtgtatattttgtgtagttgtgttcattagtttgcttctaagttctaaaatgtattttttaaaggttaatctctaactagtttagcttgcaattggttagcctatattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaagagtgtaatcataccacataaattttctttagatgatgtgcagaagaaactgattgagaatgcaagagtaactgtagggagaaacattttgatcactgatatgccttagaactacccaaatgaattacattgagggtagtcaaataaaatagatcatctcaccacagtcactgcatagaaagtggttaagtttaacataagacatgttggatgttataaaaacaaatactgtactgaatttagtctcaggaaaaaaataaattactttgttgaaaa

SEQ ID NO: 118511 - DNA, 4067 bp, Homo sapiens
  Payload ID: 3192
  Gene Symbol: C17orf104
  Gene Name: chromosome 17 open reading frame 104
  Uniprot ID: A2RUB1
  ENST ID: ENST00000409464
  CDS Start-End: 406-2385
gtgttgtggagaaataagaggtaagcatgcactgtaagttagatataggatttgaaatgaaggagaaatatttatgtggaaaagacatttccacataaaaatatttatgtagaaaagaaaatattcttgagttctagtctcttctttatttgaaatgatggtgtagattcagtccacatattttatagataaagatggtaaggtaggataagtctggaaagagtaatcaatatattgtatttcagcacgaattcatttatttttaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagtaagctgtaaaaatagataacagtggatggattttttgttaaattttttttaagtttcaggccaggcgtggtggctcactcctgtaatcccaccactttgggaggccgaggcgggcagatcacctgaagtcaggagttcgagaccagcctggccattatggtgaaaccccgtctctactaaaaatacaaaaattagctgggggtggtggcatgcgcctgtagtcccagctacttgggaggctgaggcaggagaatcatttaaacccaggaggcagaggttgcagtgagtgaagatcacgccactgcactccagcctgagtgacagagcgagactctatctcaataaataaataaataaaactctcatcaagttttagagctttgaagggtttttaaatcacatttacatctaactctctgaaatatatttttttcatgtttggtcctagaactataatatttaggaaaggggctgggtgcagtggctcacacctgtaataccagcactttgggaagtggaggtgggagaatcacttgagcccaggagtttgagaccatcctgggcaacatagggagatcctgtctctactaaaaattaaaaattagctggacatggtgtcacatgcttatgctactcaggaggctgaggtgggaagatagcttgagcctgggatgtcagggctacagtgagccataaccacaccattgcattccaacctggggaacagagcaagatcttgtctcaaaaaaaaaaaaaaaagaaaaaaaaagaaaaaggaacgggaaaatagtcccactcaatcattttaaaagtaattttcgtaatttaaatggttcctcttgaagctcaaattggcagtggagctaatcctcaactgaaagaattttttaaaaagcaaaaatcattttgagtattatttatggagaaagtctcatttctttgtcacatttgttttccagcttgatgagcaagctgtgcttacataagatggtaacttaatagggaattactatctttccttttttttttttttttttttgaggcgggtctcactttgtcacccaggctagagtgcagtggcatgatctatgctcactgtagccttgaccttctgggttcaagagatcctcctgcctaagcccccaaatagctgggactacagatgcacgctaccacacatatctaatttttgtattttttatagagacagggtttcgccatgttgcacaggttggtctcaaactcctgagctcaagcaatccacctgcctcagcctaccaaagtgctgggtgtgagccaccaccagtcaacaaaatacttttgttttggcgaagtaggatatgacttcaagtcaaatgttgtaaagaatcctcgttaagtcattttgtaatttaatgattattcctattctttataatttcagaattttctaagcaacttagggtaggtaaacttttccttttttgaccttcctctcttaaaaacttagttttccaaataaaatttgataaagattcttcctgggaaaaaaaaatgcagcaaaacggattacctcttttattgaataaaaccattttaggaattagaaaaatcaacatgggtcaaatttgtaaatctgtacaatggaatttatccatggtacattcagagcctaacatatgaggtacagccagatgttaataaaaacttcaatcttttatt

SEQ ID NO: 118512 - DNA, 553 bp, Homo sapiens
  Payload ID: 3192
  Gene Symbol: C17orf104
  Gene Name: chromosome 17 open reading frame 104
  ENST ID: ENST00000456912
  CDS Start-End: 166-553
aaccatgtgttgtggagaaataagaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatat

SEQ ID NO: 118513 - DNA, 558 bp, Homo sapiens
  Payload ID: 3192
  Gene Symbol: C17orf104
  Gene Name: chromosome 17 open reading frame 104
  ENST ID: ENST00000432494
  CDS Start-End: 69-558
aaaatgaaaaccatgtgttgtggagaaataagaggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccag

SEQ ID NO: 118514 - DNA, 425 bp, Homo sapiens
  Payload ID: 3192
  Gene Symbol: C17orf104
  Gene Name: chromosome 17 open reading frame 104
  ENST ID: ENST00000425535
  CDS Start-End: 211-425
aggcaggccaggtaacggcctctgcccccgcccctccctccccgctcggacttcccttacccgcacactggctccaggcagcgcccgggcggcggaggcggctgcggagacggcggggtgcgggctgagggagccgggcctggacgccccccccatcacccccgtaccccaggagctgtgcctagtccaggagaggctggggggcgccccatggagcccaaagtcgcgttccccggaggtgcgaatcgctgttggaacctcggcgccgacgccggcagcaggttaaccgacgtcttcggcagcgtgatgttgactggctccgcttccttctacgattgctacacatcgcagagtgaagacaatgtagacctaaggcagacctatactccattttcttcaacagaatattcaagttctgtagattc

SEQ ID NO: 118515 - DNA, 2272 bp, Homo sapiens
  Payload ID: 3192
  Gene Symbol: C17orf104
  Gene Name: chromosome 17 open reading frame 104
  ENST ID: ENST00000472403
  CDS Start-End: 1-453
gagagaaaaaagactgaattagcccttgccaagaattatcctggaaaaaaagtatccagtactaacaacactccagttccaaggctgacttccaacccatctagagttgatcgcttaattgtggatgaacttcgagaactagccagagttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtgcattagtttgagagtatacttaactgtgacatacatagcagagtcccagaagaaagaactgactactaacaaattgaaacaagtacccttcaggggaccgtggatataacctgactccttcagtgacaaaaatcaagcttgtcctgttccttcttcctttgggattcatcccgaagtgagtctcgctccagttttcgggcattaaggacatcttccacattggtgtttcggaacagaactacagaaacagctccaaataatgatggactgatcaagaagctggtaccaagaagtctcaaagttatttcaacagcttcatggagtgtttagaaacttcccagcttgaacttccaagcttcctcacaggctgtgttaaagttttcccatttataagccaatcttgccagaagaggctctggaactcaaatgggttactgccagaagaatctgggacagctgcactagtgttatatttcaaccatgtacccaatctatgaactgcttccaccaaatggtcactctgtcacccaagctggagtgcagtggcacaatcacggctcactgcagccacagcctcctaggctcaagtgatcctcccacttcagacttctgagtagctgggactacagctctgatctctctcataccctccttcccaccaccaatgattactgtaaatactgtaatggatcaagcacgacgtttgcttcagttctgcgtgggcatgaaaagacttctaccaccagcttaccttttatggactcctacatccatataagaatcaaaagggcacttcctgcaggcttctgtcatgggacagccctgggaactgccttgtaataggcacagacctcccaagagcattttaatacccccagtgaacactgtaaacggatggaaatggaattggtcgtcagatatttatgataacattcccattctgacatttcaatgccttcggaagaaccctcctcggctcactcacaagcatcggagagggccttgtccccaagaatacgagaaagcccttcctctctgtgtacctgcagctttcaggcttcccacacctggttggggagcaacctccttcccccgccgcccagatatcagaggagtatacctctcccaggatacccaagatgtaggctccataaacggctcggtccactcccagtgcctccaaccgtccgtccagccaggagccaaagccgccgcctccgccatcgccttcgccaggggctatcgcggccacttcgctgggcgccgccatcttggggtcagggtcctgcaagcccctagggcgcctaccgcagtgcctgacgggccgcgccgcaggtccaccgcgcatgcctgaagaggaagcccaggcccgtaagtgcaaagagcgcagccgtgtcggccggcttgagagttttgtgctttctagatgaagcgcgtcttcgcatacgtgcggtcgcgtgatctcacaagatgcttggcatgtgagtattcttaacagactcattctacagttcgggaagttgagagaggtgcagtaatttggccaaagtcacgcggctaataactacccaggactggagctcagcgtggatgccatcgcttcctccacccgaccgagctgccttccccgcgctttcgggggatgctggccgcccactcccacacagctgtctggcaagaacctcctgacagcctggaataccctcgtcgtcgctaccgacggctaccaccttcacctgtacaagcccttccctgtcaaagtaaaggttgcagaaaaccttccctgattccatggtaggcactcagtaaataaacaggcaacctc

SEQ ID NO: 118516 - DNA, 3753 bp, Homo sapiens
  Payload ID: 3193
  Gene Symbol: C17orf105
  Gene Name: chromosome 17 open reading frame 105
  Uniprot ID: B2RV13
  ENST ID: ENST00000449302
  CDS Start-End: 29-523
atttctgaagtgagactaggaagagaagatgaacaattccctggattatctggcctaccctgttatcgtctctaatcacaggcaaagcacaaccttcagaaagaaactggactttggccactacgtatctcacaagaatagaatacaaatagcgaagcctactgttgataccaaacctccagtggcgcacacaaatcacattttaaaattgagcaaactacagggtgaacaaaagaaaatcaacaaaatcgagtatgaaaacaagcaactgtgtcagaaaatcgcaaatgcccatcgcggccctgccaaggtggattgctggaatgaatatttttccaagagcttaaacagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaagaatgcctcattgaagtttccatggactctgttcatttatagggagcagcagcagtgaaaatgtctcaaaacatacggtgagacaatgttgcaggcctgctatgattggtcatgctagttttcagcccaactatattagtcagcatttgccaaagagacagactcaataggagagagagagagagagagagagtgagagagatagatagagagtgagagagagagagaaagagagagagagaggagaggatttatttggggaattggctcacaagatcatggaagctaaagaagtcccaccacaggccatctgcaagctggagaccctggtggagcagggcagacaacccccaaagtggggcttagcctgcgagtgttcttggcttcacccaggaaagaatttaagggtgagccagtggtagggtagaagaagacagttttattgaagcagcagtgttacagctccatgactgctcctgcagtacagggctaccccaaaggcagagagttttgcagtcatagttatacgtacttttaattacatgtagattaaggggcggtttgtgcagaaattctagggaaggagtagtaatttttttttttttttttgagatgaaatctcactctgtcgcccaggctggagtgcagatggcgcgatctcagctcactgcaacctccgcctcctgggttcaagcgattctcctgcctcagcctcccaagtagctgagactacaggcactcgccaccacgcccagctaatttttgtatttttagtagagacgaggtttcaccatcttggccaggctggtcttgaactcctgacctcgtgatccgcccgcctcggcctctcaaagtgctgggattacaggcgtgagccaccatgtccggcctataggaaagggtagtaatttttgggtccttgggtcattgccctggaaaggggtggtaactcctaggtgttgctacggtaatggtaaactgacatggcacactagtgggagtgtcttatggaaagctgcttccacccctttcctgttttagctagtcctcaattggatcctgtgtccaagccccgcctctggagtcaaggcctgcctcccacctcactgggatgctggtagcatggcttggtccaagcccaaaaacctcagaaccaagaagaaggtggtgtaactctcagttcgaggccaaaggctgagaacccactaggggggacaagggtgctggtgtgagtcttggagtacaaaggccaaggagcctagagttgttgtcccaggacaggagaggaagagtgtattccagttccagcagatagattgacatattcgcctcttgtctgtttttgttctttctgaatccacagcaagttggatgatgcctctccacattgagagtggatcttcccacatagttcactcagacttacatgctaatctcccctggaaacactcacagacacacccaaaaataatgctttaccaggtttctattcagtcaagttggcaccttaaattaaccatcgcactgactttttaaactttctattttgaaataatgaaaattcacaggtagttgcacataaaggaacagggaggcctcctgcaccctttacccagtctccaccaatgttagcatcttgcgtaactggagtacaatatcaaaaccaggaaactgacattggcatgatgcatggaacctatgcaggtttcatcagttatacatgcactcatttttgtacatatatgtatagctctatgcggtttttgccacatgtatagctttgtgtaaccacattcgagatacttaaaaccactattatcaaaagacactcttattgccacccttttagccacagtcacctcagaccctcaagcctaactcttggcaatcacaatctgttttccacctctctgttagttcatggtattacgtaaatggcgtcatgcaatgtatgttcatccttttgagattggcttttttcactcaggataatttccttgatgttcatccaagttgtgtgtgcctttttattgctgagtagtattccatggtatggacatgctacaatatatttaaccatacatccatcaaaggacattggggtagtttctagtttttcaaacattattattattattattattattattttgagatggagtctcattctgttgcccaggctggagtgcagtggcacgatcttggctcactgcaacctccacctctggggttcaagcgattctcctgcctcagcctcctgagtagctgggattacaagcatgcatcaccaggcccggctaatttttatatttttagtagagacagggtttcaccatgttgacccggctggtctcaaattcctgacctcaggtgatccacctgcctcggcctcccaaagtgctgggattacagacatgagccaccacacctggcctgattttttaaatagcaaattttgaaagttatttacatattataggaataagtcctttgcctgctatgcgccttgcatgtatttttctcccagtctataatttgtcttttcatcctcagggtctttgacagagtaaaatatttttatttggatgacatccaatatatcaatgatgaaactgttctatatcttgactctatcaatgtcaatatccttgttgtgatactgtaccatatagttttgcactatgctaccactgggggaatctggtaaggagtttacaggatctctctgtattatttcctacatgcatgtgaatatacaattatctcaaaataaaaagctt

SEQ ID NO: 118517 - DNA, 520 bp, Homo sapiens
  Payload ID: 3193
  Gene Symbol: C17orf105
  Gene Name: chromosome 17 open reading frame 105
  ENST ID: ENST00000590148
  CDS Start-End: 1-175
cagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaag

SEQ ID NO: 118518 - DNA, 3199 bp, Homo sapiens
  Payload ID: 3194
  Gene Symbol: C17orf107
  Gene Name: chromosome 17 open reading frame 107
  Uniprot ID: Q6ZR85
  ENST ID: ENST00000381365
  CDS Start-End: 228-800
aattcatgacaatgagcgtggcgaccaccatgacgaaaataaggaacctgaggagcccggaaggcatgacatcaccgttcctcctcccagctaccgaaggcgccgcgcgctgacctcacaaacacggcttctcctggtacgggctggttacgccctccagctgcgccccctacacgacgacagacgcgtcccccagcccttctcctgtcctaccacttgtggcggccatgaaggggacccccagctccctggacaccctgatgtggatctaccacttccacagctccaccgaggtggccctccagcccccgcttctgtcttccctggaactctccgtggccgcagcccatgaatatctggagcagaggttcagagagctgaagtccctggagccacccgaaccgaagatgcaggggatgctgcctgccccgaagcccaccctggggctggtgttgagagaagccacagccagcctcgtgagcttcggcaccaccttgttagagatctcagccctgtggctgcagcaggaggcgcggcgactagacggcagcgcgggcccagccccagacggcagggatccgggtgcagcgctgagccgggtagcccaagccgcagggcagggggttcggcaagctggggctgcggtgggcgccagcgcccggctcctagtccagggagcatggctatgcctgtgtggacggggtctgcaggggtctgcctcattcctgcgacagtcgcaacagcagctaggcctcggaatccccggagaaccggtgagctcaggacacggggtgagttaggggccagaggcggcggggctagggaggcactgagccggactgtcccccaagagagctactcgggagacctccaggtgacgtccagcagcagtgaggaggacggcggaccagggactccatccccgtaccagccccacccagcgtccgaataaagcccagggcggggcgagacagccagagcttttcccggggtctctgggttttggccacgcccccacccttcacactggccacacccccgcgggggctccggcttcacctgcccaggagcggcacgctcagagaagtctctgggattttctgggcaatgaggaacaagaagacggtctgggcgagcaggacgttgatggagaccgtgcatttctggccgccggctggagggagagccagtgagagcgggccccgcctcccgggagcgagcccgggtttgggggtaggttcggggccactgcttaccctgcgccggcaggaagtaggcgagcagcaccaggcccgagatgagcacacagggcacgatgatgttaatgacgtagaagagcggcttccggcggatgatgagcgagtagatgacgtcagtctcccctgggccgtcggtggcgccaccgtggtggcggcggatcacccccgggcagaagtcgatggcccactcgccgttctctgcgggacgggggcacggtcagctggctgtcagagcggggcgcccgccgagctgacagcgggctgaagaggaggctgcggctgtctgcaccagggtcatgggccgtcaggatgggggcaattacggacagaaaagggcattctcgttgagggtatggaaagccagaaggcaggactagagtaacaatcgagaatgatttcaggacaggggtaagctaaacccagttgtggaagtcatcctccagtgtcgttggtccggggcaagcccaccgtggaagtcccctctctggaccccgtctagaagcgggtttttctgagcaggcaggggcttcaccagtataggcctctgtgtcgatgtcgatcttgttgatggtcttgccgtcgttgtctacggcaaaagtgaactccacctcttcggcattgtacgtctgagagctgcggagccagggccgggagcccaccccagaagctctgacctgggccccggcctcaggcccagccctggaagctgggatctagcggggccgcgatcccaagcccaccccttcacccaagcccagcccgcacgcctctgttcccatctgtacctccggccgcgctggagcgtcccacccagtgcctacgcctggctccgcctccagcgcgaagccccgccccgagggcggtgcttcccggttggccccgccccataaggcccccccccaacaataatcgtccgggcctcggagtagctcttcccaccggaaaataagcgaacagttctgccaatcgaaggggaagtaggtgacctccactgcgcagacgctgcggtagatggccggaggcagccacgtcacggagccgccctcgtagacgagcacgttggcgtcgtaggccactccgaactggccatcaatactgtgggctcggggaaaccgagctttttgcacaggtctgcaccctctcagagtacccccttccccaaccaagtccagcccgcaccccaggccggcttccctccagcctggcgtctggcccggttctcacttgttttccagcacaatctctggcagccacacgagttctgaagggactcgcagggtttctatacccccaaagtcgtccttgctgtagttgagtcggtaatcctgccaatcctaaggggtgggggatggaaggccgcgtgccctgcatctcccacctggcgctgcctgggaggggtttgggggaaaaggggtgccctggacaagacctcacaccattccccagatttgactcacgattccaatccagacgctagtggtgagagtctcctctttttcattctgcagatgggagatggggatgattgaagtgagatttcagggccagaagtgagctttaggacagagctcagcggttggggccagaagtgggatttttggcttaagatgagggtgggggtagcttaccagtgagatgagattcgtcagggtgaccttgaggctgatggtgacagtatcctcaggctcccgcactggccggcttcctgggtcatagttgttgaagagatggtgataaagacgcagttcctcgttcttccccacacccctgcctgcgatggggtcaagaaggaagggtcattggcaatgaagaggctggagcacctctctcccctctgcctcccctgggtcctcacaggcctctgaggctgtgtactatcagtatctgtctcctaaaccaattatgctgtgcctgggaacgaaatactgtgtctaagtctc

SEQ ID NO: 118519 - DNA, 1275 bp, Homo sapiens
  Payload ID: 3194
  Gene Symbol: C17orf107
  Gene Name: chromosome 17 open reading frame 107
  ENST ID: ENST00000521575
  CDS Start-End: 346-642
agtacgaagccccaccccgacccgggctgcaccgccccctccgcgcttacgtggcgcagccgcggggacatggcgtgggtggtgggcgtccgctgggacacgttgagcacgatgacgcaattcatgacaatgagcgtggcgaccaccatgacgaaaataaggaacctgaggagcccggaaggcatgacatcaccgttcctcctcccagctaccgaaggcgccgcgcgctgacctcacaaacacggcttctcctggtacgggctggttacgccctccagctgcgccccctacacgacgacagacgcgtcccccagcccttctcctgtcctaccacttgtggcggccatgaaggggacccccagctccctggacaccctgatgtggatctaccacttccacagctccaccgaggtggccctccagcccccgcttctgtcttccctggaactctccgtggccgcagcccatgaatatctggagcagaggttcagagagctgaagtccctggagccacccgaaccgaagatgcaggggatgctgcctgccccgaagcccaccctggggctggtgttgagagaagccacagccagcctcgtgagcttcggcaccaccttgttagaggtggggtactggggggcttaggatacgcggcgatcgggtagcgggaacaaggacctctgcctccccgctaacccctgtgcccccaatgcagatctcagccctgtggctgcagcaggaggcgcggcgactagacggcagcgcgggcccagccccagacggcagggatccgggtgcagcgctgagccgggtagcccaagccgcagggcagggggttcggcaagctggggctgcggtgggcgccagcgcccggctcctagtccagggagcatggctatgcctgtgtggacggggtctgcaggggtctgcctcattcctgcgacagtcgcaacagcagctaggcctcggaatccccggagaaccggtgagctcaggacacggggtgagttaggggccagaggcggcggggctagggaggcactgagccggactgtcccccaagagagctactcgggagacctccaggtgacgtccagcagcagtgaggaggacggcggaccagggactccatccccgtaccagccccacccagcgtccgaataaagcccagggcggggcgagacagccagagcttttcccggggtctctgggttttggccacgcccccacccttcacactggccacacccccgcgggggctccggcttcacctgccca

SEQ ID NO: 118520 - DNA, 2123 bp, Homo sapiens
  Payload ID: 3195
  Gene Symbol: C17orf47
  Gene Name: chromosome 17 open reading frame 47
  Uniprot ID: Q8NEP4
  ENST ID: ENST00000321691
  CDS Start-End: 183-1895
atcaccagacagagaggtagctaaggggattatttgagacactcttagaacaacagccacttttgtgggagcccaagaaacagcagctttaaaacagggtaaatattcaggcatcattaggatcctgaatacaagccagccagtaaaatacgggatctactcagaagggcacaatctatcagatggtcaagacaaataaacctggggccaaggtagcggtttcagcacagagagggtctgaggttactactaacacatcccctcagcagggacatgggtacgttcttgcctcaagccatcgaagtgctgcagtctccctgaacccttcccaccgaagatcagaagctgcacatcccaccactccccattcagcatcagactaccctcgatctgtctccctccagtcaggacctggacactatgcagtacccactcctcggggacccgagactggaccaagaacagaatcatcccgccattcctctccccatctaaagagccagaagactcagacactggcttcccatgcttcaagcagacaatggaaagttagtccacccagagaggaagcagcacgaagaggcagtgagagcaagtcagggcgcgaggtcggccatcatgcttcatcaatcccagatgccaaatctactcatcagttgagttttcaagaccagaagaataacttacaatcacaaatcttagaagatgacccaccatccaaggtccagaacccccaaggagtcagagttccccgtaggattttgtcttacccaaaggatgaagcagtacaaactgagcccatccaaagaattacgactactagtgagatcagatctccaaggagtccctctctcctagagcacggaagcagctgtgtctctgcagactatcagacagcccagagaagggtccctgtagaagaatcagaaacaggtccttacggtccaattccttcaaaacccaaggccttgtataggaatatgaacttggactcattgctcaaactctctgtccttaaagattctgatggtgtacaccgagtttctgcacgggtagaccctgagtctcttcataagtattctgcctatcctgaaaccaagccctccgcaaaggtcttagtatcatcacaggtggagtccaacgtgaggaccccaatccgaggaaacagcgaggttggccgcagggtcaccatctccccaggggtacagtcagtagagccaactcaccatgtgacagttccatcagtgtctgagggctcccacaagtcatccatgtttgttactccagagcccatctataaacagcaaacccaaaaacccccagaaattacttacatgtcccaaggacctacacccaggtatccagaactctcgcaaaagccctccatccatgcagaactggaactgacccctaggcccttgcctcctcggtccttacctaggtacggacctgactcctcatggtggcccttgctgaatcctgaagttgaaacaccccaaagccagctgacaacaccggattttgagcctaagtgctctccttccctagatcttttattgtccggttttaaaatagactctagccctttctgtgaggatctgaagttccagagagagaaggcaagcctatcaccaccatcaccaccaaaggagtttccaagttgggcaccactgagtgaagtgccacagacccccaagcacacctgcaaacaacccattcaaaggtttactgctttcttcctggatgtctctgaggaaatgtacaatcgtgtcatctggtggctaaaaggtctgtgcttttccctcctatgggcccactgtgggagcttgggggatgggaggacaggtgaggagtggcatctatgtatctacagagctgggtcgtttaggagataaatgctgggattttgacctgaagaagcagaggaacttctcatcttgctgaaaatttcaccattagagtcatttctttggggcttggaaccttttccattttcaagagtctccttttaacaggaagttacttctggaatggagaataatttaagcctcatggccttttcagcttagttggtcatctatcacatgattttaaaaaatacaccaaagcaaaccgcctgcttc

SEQ ID NO: 118521 - DNA, 850 bp, Homo sapiens
  Payload ID: 3196
  Gene Symbol: C17orf49
  Gene Name: chromosome 17 open reading frame 49
  Uniprot ID: Q8IXM2
  ENST ID: ENST00000439424
  CDS Start-End: 77-595
agtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggtgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctca

SEQ ID NO: 118522 - DNA, 779 bp, Homo sapiens
  Payload ID: 3196
  Gene Symbol: C17orf49
  Gene Name: chromosome 17 open reading frame 49
  ENST ID: ENST00000552775
  CDS Start-End: 80-580
cgtgacgctgccccgcccccaggtcggagagatcttctcggcggccggcgccgccttcacgaagctcggggagctgacgatgcagctgcatcccgtggccgactcttctcctgcgggtgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctca

SEQ ID NO: 118523 - DNA, 764 bp, Homo sapiens
  Payload ID: 3196
  Gene Symbol: C17orf49
  Gene Name: chromosome 17 open reading frame 49
  ENST ID: ENST00000546760
  CDS Start-End: 106-579
gacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggtgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataa

SEQ ID NO: 118524 - DNA, 996 bp, Homo sapiens
  Payload ID: 3196
  Gene Symbol: C17orf49
  Gene Name: chromosome 17 open reading frame 49
  Uniprot ID: Q8IXM2
  ENST ID: ENST00000546495
  CDS Start-End: 364-942
gtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggtgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggacagcctgaccctggattctggccttctcatgacctctgctgatcctcctctcctctcctgctgagccttccacctctgacctctcactgttcatgccggacctgtggatctcctggga

SEQ ID NO: 118525 - DNA, 760 bp, Homo sapiens
  Payload ID: 3196
  Gene Symbol: C17orf49
  Gene Name: chromosome 17 open reading frame 49
  Uniprot ID: Q8IXM2
  ENST ID: ENST00000552402
  CDS Start-End: 90-506
gcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctc

SEQ ID NO: 118526 - DNA, 430 bp, Homo sapiens
  Payload ID: 3196
  Gene Symbol: C17orf49
  Gene Name: chromosome 17 open reading frame 49
  ENST ID: ENST00000547747
  CDS Start-End: 1-70
tcacatcagctgtgtcatcaaggaacggacagtggcccagataaaggccactgtgaaacgcaagatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcag

SEQ ID NO: 118527 - DNA, 569 bp, Homo sapiens
  Payload ID: 3197
  Gene Symbol: C17orf50
  Gene Name: chromosome 17 open reading frame 50
  ENST ID: ENST00000603305
  CDS Start-End: 44-565
gatcagggaaagcagggcacagccttgggaagaatggataagcatgcaggactgccctgacctcctcccggcccgcaggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaaggcg

SEQ ID NO: 118528 - DNA, 477 bp, Homo sapiens
  Payload ID: 3197
  Gene Symbol: C17orf50
  Gene Name: chromosome 17 open reading frame 50
  ENST ID: ENST00000604830
  CDS Start-End: 46-456
atcccagtctctgatcagggaaagcagggcacagccttgggaagaatggataagcatggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaaggcgggggccgctgggaactc

SEQ ID NO: 118529 - DNA, 1018 bp, Homo sapiens
  Payload ID: 3197
  Gene Symbol: C17orf50
  Gene Name: chromosome 17 open reading frame 50
  Uniprot ID: Q8WW18
  ENST ID: ENST00000605587
  CDS Start-End: 33-557
atcagggaaagcagggcacagccttgggaagaatggataagcatggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaaggcgggggccgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtca

SEQ ID NO: 118530 - DNA, 7914 bp, Homo sapiens
  Payload ID: 3198
  Gene Symbol: C17orf51
  Gene Name: chromosome 17 open reading frame 51
  Uniprot ID: A8MQB3
  ENST ID: ENST00000391411
  CDS Start-End: 259-924
gcatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaagaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcatgaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaactttatgcttctttcagcaaatattttctgctcgtctctatgagtcaggcactttgctagataacataacatagaaacatagcatcaatccaatatggtgtgggtactgtatgtcaaatttaaaaataaaagtgctatataagaaacctctcagtgccctggaggcagggtccagagacatatcctgtggatgactggggctgaggtttaagggatgagcctcggtgatgagacagacgggagagggcaccctaggaaaagcgtcttcaggcaatcgtggttcagtgagctgcagccgtcgcggcaggagattgaggagcgcggcctatctggtgatttgctgtggttatgttctgtaaactcgccttgggtcctgaagtattgcttctggggaaacacagggtaaggttcctgcaagcctctggttgcaatattttcaactgccaaggcaccattcatgttccatgggttcattttccaacatccctgtaaaacaaggcagtcccatcagtgttgaaaactgctctccacatacccttttcccgtagagtacttcctgatctacagagctgccactcctgaaaagctaacactttccatgccatgctgccttttgaaaggtgccagccaggcagcattagctaaggcctctttttggctctcctcacaacagtgctgcccgctgtgctttcattggtcatcatctcatgaagtcacaaatgtagctgcttttctatggtttccatggttttgccacactctaggggatattagttttgcactttcccaagcagcctcgtgtacaggttggtgaagctccccttcctctttctggatgcactgtagtgtttgtcattagcgttgaactcacagttcgcagcactagaacccacacctgaaccaagcttggctaacaagcgttttctctgtaaggcacattacagccttcttgctcataaggacactagacagcgcttcagcattatgcttggaggccgtttcaaacagtgaaatcaacaacaagaagctcaaaactgcaaaagaagtggtactatagagaccatgagaagactggtttgcaggttgagagtaggaacaagaaggcagcgtggggccctgcatggcctccgctgggaggccgatggctcaaattgttgccctactctgcacatgttttcctgtgactgtgaaagcaacacgagtattgattcgggggttaaaaatacattttaacaagcagaaaagttcacaaatatgaaatagtggctagtgaggaccacccccatgctggagctgcagacagaggcttttgtgagtgcgaggcttgctcctatcccgggagcttctggttgccaccagcaccttgtaagccagggagtggtgtcacctgtactgtagcaaaagcaccttttctaaatgtgaagtatggcttgaagagaggaagatggaagatggctgtgttagggatgaagcaaggatgggggtggattgaccaagctgggccagaggtgcgaggagctgatctgcgagccctgtgtgcctgtgagtcctggcggagtggccgtgcgtggtgacagggaggaggcatccaggacagcacccacgttcccgcctgaggcacatgagggtggatgacagggttcggggccctagccttcaagtcagacacacctgagttcaaatccagactccaccactgactggctatgtagccttagacatgttccttcacttccctaagcgtccattttctcatgtccaatacatagattactatgccataggaatattaaatcactcagtgattttgaggttaaaatgagtgctggtgctttttattgaaataaaatgggaaaagaagcagcatttgaggtgtgagggaggggaatctgggcatggggagttggatgtgcctgtggacacccatggacaaatgtccagcagccatccaatgtgctttcgggatgctggggccaggatgtggggcagcaacatacagacctggaagttacaagcaggcaggcagctgctgcagctgtgaagagcaggcagtgcaggatcagaggcccagggtaaagcctggggaatgccagcatttagaaagaggccgctggagatcagaaaagagcaacaggaaaagcaggagggtgtggagggatgggaggtgcaggaggagagtttccaagagggaggggcaggagtcggtgttctgcaggcatggactggaagtcgtagtacttttgaactgtagggacctaagacatcttttagtctaatccccttatctatccggaagaagaaatcatgattccaaggtgacatgagttgcttgctttaggtcacagtgatttcacattgggatacctcgatttctaatgagtaatagaatatttaataaatactctcgaatttggaattgctcctattccagtcacactggatattttcccaatttggtgaaactgatattttaacaactgttaaccattccatgtactaagatgcttatagtcaaactgtgcctcttaaacctatttttattgtgtatttaacaaattttgctataatgttaaaaacaacttataactcatcaaactgcattttaattttagtaaacacaaattacactgaaacgggagtgttccctggcccctctcacaggacgtgtgacaagggttcggctcgctgcctgttcaaaccccttacgggagggggatcacgcagagggacaggtgcaggagcccaagtgggtgtgtgctacagtgtgctcttttagccttggcatctgtggatggcttgagtgttaactagctcagtggaccctcagcctttctgcaaaggcagagggtcattgtgacagctttctgtatcccaagctcttgtccatgatcctggaagaatcaggtcacacacagacttgaaggataaatgcaggggtttcactgaggggtagaagtggctctcagtaggatgcatggggagctggaagtggggagggagtgcgaagacgatcttcccctggagtttggccactggacggccaaactcctctcttaccacccgcagctgaactcctctcagcgttcaggtgttcctcatcttctcactttctctgccatgccgttctgctgtttgactgcttttctcttcatctcttcatctgctcctggagcctggggtttggggtttatatgggtacaggatacgggggtgtggtgggccaaagggcaactttttgggtacgaaaacagaaatgcctgttcccagttagggccatgggtctccaggcttgagggtggggcctttgctggggagccgccctcttctatgcagtatttccctgtctcttttctatatcaatacctcaataaaatttagttttaaaaaatagcacatgtaaaaagtttggctatttaaactaaaaagtaattatgtcctaaattattttgtatacaaagacctgaggacttgaaatattgtaataattggagcttgtctctgctttaagggcaccactcgcccctgatccatcttggtttcccgcacaaggcagcaggattgcccatgaatgaacatgggtgaaatcgttggatacaggtagtaaatacattctatttcctgaaaaatattacctaactacatgtctagatatggaattgcattttcaagccaagctggaattacaaattgtagcccatttgaaaatgcatacaaatgtgtgacatatacacccagaggaaaagaagtcacagttatgaaagaacaaagtgggaaaatatctttttcatgtaagattgagcattttggttgatactgtgataaaaaatcttgtgactgattctcttttgcattggtttttagtgtcatgtgcactctgcccaactcagataaaattgtatatgatgtaaatagcaggaaactataaatggtgatattgtcctgaaaggaagccacttcatttttcaaagatttcttccgcggcagggatctaggagtgtgcagggatggagttttgcatttctagaggaaacagcaggcagggtgtgtgcagccggaaagggggcgtctaggttccaagggcaaatcccacccccttagaggggattggagagcctgggaaagaggctgggctgcctgtgatccccaccccacaccctgcctcctacaagcccctagaaggtccacactttgagttgtcagccagagacagtaactcaaaacctcggcttcgggcagccagaagcccagaaatgggggagagggcaggcctagacaccagggatgaaaataaagtgaatattaaaaatta

SEQ ID NO: 118531 - DNA, 877 bp, Homo sapiens
  Payload ID: 3198
  Gene Symbol: C17orf51
  Gene Name: chromosome 17 open reading frame 51
  ENST ID: ENST00000412778
  CDS Start-End: 259-807
gcatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaagagatggggtctcactctattgtccaggctggtcttgaactcctagcctcaaacaatcctcctgcctcagcctccccaagtgctggtattacaggaatcatctcccctgccccacaaacatgaaagaaaagacaagagaagcaccccagaagaggaggggagaagtgccccagaaaaaatcatccagtctctg

SEQ ID NO: 118532 - DNA, 2272 bp, Homo sapiens
  Payload ID: 3199
  Gene Symbol: C17orf53
  Gene Name: chromosome 17 open reading frame 53
  Uniprot ID: Q8N3J3
  ENST ID: ENST00000245382
  CDS Start-End: 122-1687
gcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 118533 - DNA, 2725 bp, Homo sapiens
  Payload ID: 3199
  Gene Symbol: C17orf53
  Gene Name: chromosome 17 open reading frame 53
  Uniprot ID: Q8N3J3
  ENST ID: ENST00000319977
  CDS Start-End: 238-2181
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaagcaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 118534 - DNA, 2529 bp, Homo sapiens
  Payload ID: 3199
  Gene Symbol: C17orf53
  Gene Name: chromosome 17 open reading frame 53
  Uniprot ID: Q8N3J3
  ENST ID: ENST00000585683
  CDS Start-End: 236-2176
tttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctg

SEQ ID NO: 118535 - DNA, 1535 bp, Homo sapiens
  Payload ID: 3200
  Gene Symbol: C17orf58
  Gene Name: chromosome 17 open reading frame 58
  Uniprot ID: Q2M2W7
  ENST ID: ENST00000334461
  CDS Start-End: 316-543
cggccgcccgcgctcgccaccgagggctccgccggccacgcccaccccaaccggccgcgcgccgccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatgggaaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgttt

SEQ ID NO: 118536 - DNA, 1296 bp, Homo sapiens
  Payload ID: 3200
  Gene Symbol: C17orf58
  Gene Name: chromosome 17 open reading frame 58
  Uniprot ID: Q2M2W7
  ENST ID: ENST00000449250
  CDS Start-End: 191-484
cagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatca

SEQ ID NO: 118537 - DNA, 1654 bp, Homo sapiens
  Payload ID: 3200
  Gene Symbol: C17orf58
  Gene Name: chromosome 17 open reading frame 58
  Uniprot ID: Q2M2W7
  ENST ID: ENST00000536693
  CDS Start-End: 407-634
cgccgcgcttcagcctcagcttcggcctcagcccgccgcagagggacgcggagcccggcgctgagccctgcgcgcgcgcctgccggtccgatctggacgaacgcgaggcgttctgcgagagcgaattcggtgagcccggccgccgcgccgccgccccgccgccccgcgagcctttccgagccccggagaatccgcccgcgagatcccagggcgcctgacccgtgcgggccgtttcgcggttgctaaaaaccacctcctgggggactgggagaggaactcggggtaatgctcttctccaaactgtttttcggaagcagcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatgggaaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatc

SEQ ID NO: 118538 - DNA, 2093 bp, Homo sapiens
  Payload ID: 3201
  Gene Symbol: C17orf62
  Gene Name: chromosome 17 open reading frame 62
  Uniprot ID: Q9BQA9
  ENST ID: ENST00000306645
  CDS Start-End: 169-732
aatcccggaagcgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 118539 - DNA, 2217 bp, Homo sapiens
  Payload ID: 3201
  Gene Symbol: C17orf62
  Gene Name: chromosome 17 open reading frame 62
  ENST ID: ENST00000336995
  CDS Start-End: 727-1410
ggcgaccagagttgctgggcagtcttgggtttagtgccgcaatgctgcacttctgacaggctgcttcctggatccctgcagggacctggccagggcattggccccaggtcacctgtggctttggggagagcagttgcagggctggcctgggctgtgggaggcagctgtgccgttttctgacagccattgggaccgccccagtacccgaagaggtggctgccctgagttgccacgggaaactgcagggtggccctggctcagcagccaaccttggggagacctggaggaacagtgcagtgtaaagatggcctcgcgctgagcgggtccccgcagtcggcactcccaggagaaccagcgggctgtgcatgtgacccgccagcctgcaccgcgggcacgtccttcccacccagaggaccctgcactgccttcagggccacagcagtcctccggggcccagcctcaggcaggaaacagcaaatgcttttgctgccaaccaagtgtggctgtcgctttcgatgatgccagtggcgctggtgcgactgccgggcagcatgtgtgggcggggatggctcggccactgaccgtctccccgcagtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggagtctcgccagccctggactcctgctttgggccacagcaagacctcgggcgagtggagaggcgggccaggccggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 118540 - DNA, 1849 bp, Homo sapiens
  Payload ID: 3201
  Gene Symbol: C17orf62
  Gene Name: chromosome 17 open reading frame 62
  ENST ID: ENST00000342572
  CDS Start-End: 243-434
ggaagtgcgcgcggccccgcccccgccggttcgcgtctctctgctgcggcgcggggaccgctgtgctctcggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcacctgcagcttccactctttatttccaaagaatcagtgtcacacatgcagatcac

SEQ ID NO: 118541 - DNA, 2242 bp, Homo sapiens
  Payload ID: 3201
  Gene Symbol: C17orf62
  Gene Name: chromosome 17 open reading frame 62
  Uniprot ID: Q9BQA9
  ENST ID: ENST00000437807
  CDS Start-End: 319-882
tgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 118542 - DNA, 2050 bp, Homo sapiens
  Payload ID: 3201
  Gene Symbol: C17orf62
  Gene Name: chromosome 17 open reading frame 62
  Uniprot ID: Q9BQA9
  ENST ID: ENST00000434650
  CDS Start-End: 169-690
aatcccggaagcgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 118543 - DNA, 1965 bp, Homo sapiens
  Payload ID: 3201
  Gene Symbol: C17orf62
  Gene Name: chromosome 17 open reading frame 62
  ENST ID: ENST00000584024
  CDS Start-End: 116-358
aatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 118544 - DNA, 617 bp, Homo sapiens
  Payload ID: 3201
  Gene Symbol: C17orf62
  Gene Name: chromosome 17 open reading frame 62
  ENST ID: ENST00000577888
  CDS Start-End: 165-401
atcccggaagtgcgcgcggccccgcccccgccggttcgcgtctctctgctgcggcgcggggaccgctgtgctctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacag

SEQ ID NO: 118545 - DNA, 866 bp, Homo sapiens
  Payload ID: 3201
  Gene Symbol: C17orf62
  Gene Name: chromosome 17 open reading frame 62
  ENST ID: ENST00000583617
  CDS Start-End: 57-629
gggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggc

SEQ ID NO: 118546 - DNA, 741 bp, Homo sapiens
  Payload ID: 3201
  Gene Symbol: C17orf62
  Gene Name: chromosome 17 open reading frame 62
  Uniprot ID: Q9BQA9
  ENST ID: ENST00000585080
  CDS Start-End: 171-734
atcccggaagtgcgcgcggccccgcccccgccggttcgcgtctctctgctgcggcgcggggaccgctgtgctctcggctggagtccagtggcacgatttctgctcactgcagcctccacctcccggcctcagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagcccc

SEQ ID NO: 118547 - DNA, 269 bp, Homo sapiens
  Payload ID: 3201
  Gene Symbol: C17orf62
  Gene Name: chromosome 17 open reading frame 62
  ENST ID: ENST00000579751
  CDS Start-End: 1-267
gttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagcgtcctctccctggtggacatccccagcggtcaggtgcttccccaagggcagtgagg

SEQ ID NO: 118548 - DNA, 497 bp, Homo sapiens
  Payload ID: 3201
  Gene Symbol: C17orf62
  Gene Name: chromosome 17 open reading frame 62
  ENST ID: ENST00000584408
  CDS Start-End: 83-319
ggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgca

SEQ ID NO: 118549 - DNA, 656 bp, Homo sapiens
  Payload ID: 3201
  Gene Symbol: C17orf62
  Gene Name: chromosome 17 open reading frame 62
  ENST ID: ENST00000577696
  CDS Start-End: 265-656
gtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgc

SEQ ID NO: 118550 - DNA, 1053 bp, Homo sapiens
  Payload ID: 3201
  Gene Symbol: C17orf62
  Gene Name: chromosome 17 open reading frame 62
  Uniprot ID: Q9BQA9
  ENST ID: ENST00000577732
  CDS Start-End: 335-898
gccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacaggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtg

SEQ ID NO: 118551 - DNA, 1127 bp, Homo sapiens
  Payload ID: 3201
  Gene Symbol: C17orf62
  Gene Name: chromosome 17 open reading frame 62
  ENST ID: ENST00000582725
  CDS Start-End: 67-222
gggctcagctgcctctgtctgttcccagacccctcctcctgtagagagtggtgctgccctctcgggatgtacctgcaggtggagacccgcaccagctcccgcctccatctgaagagggctccaggcatccggtcctggtccctgctggttggcaggcagtcactttctcttcataggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgct

SEQ ID NO: 118552 - DNA, 573 bp, Homo sapiens
  Payload ID: 3201
  Gene Symbol: C17orf62
  Gene Name: chromosome 17 open reading frame 62
  ENST ID: ENST00000577471
  CDS Start-End: 215-573
gtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtactt

SEQ ID NO: 118553 - DNA, 809 bp, Homo sapiens
  Payload ID: 3201
  Gene Symbol: C17orf62
  Gene Name: chromosome 17 open reading frame 62
  ENST ID: ENST00000582438
  CDS Start-End: 1-179
ggaaaggctacatggtggtgctccggcttgcgacgggcttctcccaccccctcacgcagagtgcagtcatgggccaccgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcc

SEQ ID NO: 118554 - DNA, 1074 bp, Homo sapiens
  Payload ID: 3201
  Gene Symbol: C17orf62
  Gene Name: chromosome 17 open reading frame 62
  Uniprot ID: Q9BQA9
  ENST ID: ENST00000585064
  CDS Start-End: 330-893
ggaagtgcgcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacag

SEQ ID NO: 118555 - DNA, 841 bp, Homo sapiens
  Payload ID: 3201
  Gene Symbol: C17orf62
  Gene Name: chromosome 17 open reading frame 62
  Uniprot ID: Q9BQA9
  ENST ID: ENST00000578919
  CDS Start-End: 166-729
aatcccggaagtgcgcgcggccccgcccccgccggttcgcgtctctctgctgcggcgcggggaccgctgtgctctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcct

SEQ ID NO: 118556 - DNA, 563 bp, Homo sapiens
  Payload ID: 3201
  Gene Symbol: C17orf62
  Gene Name: chromosome 17 open reading frame 62
  ENST ID: ENST00000578913
  CDS Start-End: 63-509
ggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcaggtaaggctgtgggactttgatctggccggagctgcagccgtagcaggtcactcccgtt

SEQ ID NO: 118557 - DNA, 540 bp, Homo sapiens
  Payload ID: 3201
  Gene Symbol: C17orf62
  Gene Name: chromosome 17 open reading frame 62
  ENST ID: ENST00000577834
  CDS Start-End: 188-540
gttcgcgtctctctgctgcggcgcggggaccgctgtgctctcggctggagtccagtggcacgatttctgctcactgcagcctccacctcccggcctcaggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccg

SEQ ID NO: 118558 - DNA, 470 bp, Homo sapiens
  Payload ID: 3201
  Gene Symbol: C17orf62
  Gene Name: chromosome 17 open reading frame 62
  ENST ID: ENST00000582545
  CDS Start-End: 215-470
gtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcagacccctcctcctgtagagagtggtgctgccctctcgggatgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccagg

SEQ ID NO: 118559 - DNA, 1079 bp, Homo sapiens
  Payload ID: 3201
  Gene Symbol: C17orf62
  Gene Name: chromosome 17 open reading frame 62
  Uniprot ID: Q9BQA9
  ENST ID: ENST00000577436
  CDS Start-End: 214-735
aggacataaggtttccagacaggacggggcaggtggtgatgcagctgtagctcgtgagtctgagcgggaaacagcccccgcgcagtcggtgtcgctgtgaacggaaaagggccttccttacacaggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttc

SEQ ID NO: 118560 - DNA, 584 bp, Homo sapiens
  Payload ID: 3201
  Gene Symbol: C17orf62
  Gene Name: chromosome 17 open reading frame 62
  ENST ID: ENST00000584503
  CDS Start-End: 326-517
cgtctctctgctgcggcgcggggaccgctgtgctctcggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgag

SEQ ID NO: 118561 - DNA, 668 bp, Homo sapiens
  Payload ID: 3201
  Gene Symbol: C17orf62
  Gene Name: chromosome 17 open reading frame 62
  ENST ID: ENST00000581196
  CDS Start-End: 376-567
aatcccggaagcgcgcgcggccccgcccccgaaagtcggctcggctccgctccaatcccggaagtgcgcgcggccccgcccccgccggttcgcgtctctctgctgcggcgcggggaccgctgtgctctcgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattc

SEQ ID NO: 118562 - DNA, 468 bp, Homo sapiens
  Payload ID: 3201
  Gene Symbol: C17orf62
  Gene Name: chromosome 17 open reading frame 62
  ENST ID: ENST00000584891
  CDS Start-End: 416-468
ccccgccggttcgcgtctctctgctgcggcgcggggaccgctgtgctctcgtaatgaggtctcgttatgttgcccaggctggtctcaaactcctgagctcaagcgctcttccttcctcggcctcccaggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgc

SEQ ID NO: 118563 - DNA, 564 bp, Homo sapiens
  Payload ID: 3201
  Gene Symbol: C17orf62
  Gene Name: chromosome 17 open reading frame 62
  ENST ID: ENST00000580560
  CDS Start-End: 271-462
gctgcggcgcggggaccgctgtgctctcgcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcc

SEQ ID NO: 118564 - DNA, 950 bp, Homo sapiens
  Payload ID: 3202
  Gene Symbol: C17orf64
  Gene Name: chromosome 17 open reading frame 64
  Uniprot ID: Q86WR6
  ENST ID: ENST00000269127
  CDS Start-End: 85-795
cggctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaagagcagccagccggccaagttcctggtgacattctgcgcctcggatgcgccggagaggtccttgctggccgaccgggaagacagtctgcccaagctctgccatgcatgggggctgcacagcaacatcagcggcatgaaggagcggctgtccaacatgcagaccccaggtcaagggagccccctgcctgggcagccaagatcccaggaccatgtcaagaaagattctttaagggagctttctcaaaaaccaaaactcaagaggaagaggataaaggaagccccagaaactccagagactgaaccgtaagaagaccaactgggacaaagggcccgcttgtcctggctctcagagcacggggaatggagaccaaaaagggaaaagaattgtccttatcaaaaagattctcaggtcttaattaggaataaatgaggtgggaaataaacattcttatgacagttcta

SEQ ID NO: 118565 - DNA, 403 bp, Homo sapiens
  Payload ID: 3202
  Gene Symbol: C17orf64
  Gene Name: chromosome 17 open reading frame 64
  ENST ID: ENST00000474834
  CDS Start-End: 109-403
gcccaccgcgtttccgccctcggcctcgggtccctggagggctcgcgggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaaga

SEQ ID NO: 118566 - DNA, 203 bp, Homo sapiens
  Payload ID: 3202
  Gene Symbol: C17orf64
  Gene Name: chromosome 17 open reading frame 64
  ENST ID: ENST00000461535
  CDS Start-End: 175-203
ggcgcctccgctggcgacggggggtggtgacttccggggcgcttgaggacgaccccccccgcccccgcgcccacatgttctggcgttcggcgggtggggtccgagcagctgacggtgacaaatgtgtcatgcctggagacaagctccagcgccagccctgctagagactcgctcatgcgccatgccaagggcctggatcagga

SEQ ID NO: 118567 - DNA, 2013 bp, Homo sapiens
  Payload ID: 3203
  Gene Symbol: C17orf67
  Gene Name: chromosome 17 open reading frame 67
  Uniprot ID: Q0P5P2
  ENST ID: ENST00000397861
  CDS Start-End: 1281-1553
ggatggagggttgaatgccaaaacttcgtaatcgtagaaaattctggaaagccgccggcggggcaaggccacgaggatcctcctcgcagcaccgcgccgcgcggggcccaggggccgcgctcacgcccgccgctcggcgcagacacgagtgcccccgacttgagccgaacctctagccgatgccggcgccgccgccgccggggatgcgtaagccgactgggaagcgagggggggaggcggcctgcgcggcaccgcccgacctggccgcggcgggctgagccccaggttccggaggaatgctcgctccccgctggagtcctaccagcccaacacggacctgagccgcgaccacgcgggctgcagcctgcagcacatcagctacccggagaacgcggacgcggaagcaccgctgctcagcacccccgaagaaacacggaatccagagaggcacaggcaccgccccggcgcgcacagctgcactcagcggcttccttcctactacatacatacataggagtgggagccgaggaccacttgttgcttgcggacttcctctagcataaaagatggaaagaaaacacacaccgaagcaagggaccaaaggaacagaaaagaaacgcagagatcataggaaaactgcaaagaaatacttgataatatcttccaaacgattagagaagacataacattcattaagaatacacatatagatgtatatatacgtatgaagaaaacctgcttgatatcacacagtcaggagtcaactgagttggggctttgaacttaggtttatctgatgccaaagtttgtgatgctcttcaaccatttagggtaccgcagagtgtggattttgaatcacctgcatcagcatcattttaaaatatagattctgtggtcctgaccaggtctctgaagtcagaatatgaagtggagctaggaatctaacttcttaacaagttccctagatgcctaagggtatccctgaatgatacagttttgtttgaaagactgaaaagcccaaagctggcccttttgggaaatagcagtaaatcattgatatgtgaaggttcccagcaggaggatgaaaatttacaggaattcggaggaaaatatttcagtggtcattactaaaacgctcagagtcagatacattcagcatcataccgtaagtcccgttagtcaaagcataaacaagcgcagggcctggcatggcttccttcaagttggctgactcagtctgggaggattcactcagcaagaggcagaggaaccaaggcaggatgaagacattgcctgtgctcgtgctgtctcttaccttactgactgtcttctcagagacctccccgattttgacagagaagcaggccaaacagctcctaagatctcggcgacaggatagaccaagcaaacccggattccccgatgagccaatgcgggaatacatgcaccacctgctcgccctggagcatcgcgctgaggagcagttcctggagcactggctgaaccctcactgcaaaccccactgtgacaggaacaggattcatcctgtgtaaggggatcaggaccagcctcgcaagcattttaatagacaacaagctggataatgtcgaagcaagacaaggctgcttctttcacttgtttttaaattgcagaaatggatgtcttcagacctcgtgaactgtgggcatatcaaagattgccttggaaatggcaaatatatatactgcttcattttactaacctgcatagatcactaaaaccaatagcttaaagcatagacacctcccaaaggtcttcccatcagtttgcaagagtgggaacaaccagaatcttacctggggttgatggagctggaactcccagaccaggagttggggcaggctgcctgccctaaggaatttggggaatccttgttcagagtagtgaagcataccacttggggttgctgagttgttttgtcctctatttttttcctcttcttttctgccctaataaacattggtattaaattta

SEQ ID NO: 118568 - DNA, 1651 bp, Homo sapiens
  Payload ID: 3204
  Gene Symbol: C17orf74
  Gene Name: chromosome 17 open reading frame 74
  Uniprot ID: Q0P670
  ENST ID: ENST00000333870
  CDS Start-End: 75-1580
gagtgcagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgccgccgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaa

SEQ ID NO: 118569 - DNA, 1287 bp, Homo sapiens
  Payload ID: 3204
  Gene Symbol: C17orf74
  Gene Name: chromosome 17 open reading frame 74
  ENST ID: ENST00000574034
  CDS Start-End: 49-426
gtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaagaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaa

SEQ ID NO: 118570 - DNA, 4581 bp, Homo sapiens
  Payload ID: 3205
  Gene Symbol: C17orf75
  Gene Name: chromosome 17 open reading frame 75
  ENST ID: ENST00000225805
  CDS Start-End: 71-1261
gataccgacggctgcacgggagcaggggagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagactttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaaaaaaaaaatgtaattctagtcttagaacagattaataccactacaccagttcagagatagatctgtgcatcctgtgggtgcttgatacatttttttgtctagttgataacggcatggatgataaagtcagattttaagtcaatatgcaaatcctgagtatgtagaaaattaaatgagctttacaaatcgatgcactagcttcaagataaaatattatctttgagctgggcgcagtggctcaagcctgtaatcccagcactttgggaggctgaggcgggcagatcatgaggtcaggagatcgagaccatcctggctaacacagtgaaagcccgtctctactaaaatacaaaaaattagccgggcatggtggcgggcgcctgtagtcccagctactctggaggctgaggcaggagagtggcgtgaacccaggaggtggagcttgcagtgagccgagatcgcgccactgcactccagcctgggcgacagagcgagactctgtctcaaaaaaaaaaataattatctctgagagaaagctactgcagaaatcgccttcagtcaccatttcatttatttgttcacaggtatttatgaagagcctgtgttttcttttaggtgaaaatgctggagttttaaaacagtgttgagaaaagaaacaaagtacatacagtttacaagcaaactgtaacataaggaatgcaaacagtttcttcctattagagttactcattgattttagttttttgtacatttgttacaagcctcagattgttttactctgaatcaattgaaagtgccctcagctagccatttacaattcccatggaagcctatgtagctacatacatacaattgcaatttgctcgggatagctctttaataaattcatttgataatgatttttgcttagaagaacagaagtcttgtgttctcacttccctgaggatgctcagaggagcacaaacccataaaactgaggaatcctctcttaaatggatctaaattcacattaagtgctgagttttaactttcaaaatgactgacaatggccttctgctttctcctctacataagcctcgggacatgactcacatttcttttcttttaatgagaaatacaattcagaatcttcataaatgctttcatacggttttaaactttaataacttggaatgtaggcagtatagaaaaaaatctaagtagcatttttcatagtattaaagtgagagtggctgggcacgatggctcatgcctgtaatcccagcactttgagaggccgaggcaggtggatcacctgaggtcaggagttccagaccagcctgaccaatatggtgaaaccctgtctctactaaaattacaaaaattagctgggaactgtggcatgtgcctgtagtcccagctacttgggaggctgaggcaggagaatcgcttgaacccgggaggcagagattgcggtgagccgagatcgcgccactgcattccaacctgagtgacagagcgagactctgtctcaaaaaaataaagtcagggtgactaaggaaaaccagcaattttatgacactgtccttgaatctgactgtcttttcccaatgtagttggttccccacttggaaatcattttttaaagtaagctacattagcacatcaacgttttaagtctgaaaaaatacttcattttcaaattcatgtcattcaagagtctatgttgtaaatggcatttaaaagcaaatgtgttacctgcttcaaatcatttatggatataggcaaggtgtaattacatattctctgtgtggttgtatatatttttgtaatgtaggctcactacattacacagctctatatgatagtcttattttatctttttttttttttaatgaaatggggtctcactatgttgctcagactggtcttaaactcttggactcaagcaatcctcccaccttggcctcccaaactgagccactgcacccggcctctggtagtcttattttaaaaaaagtaagtctgggctgggtgtggtggctcatgcctgtaatcccagcactttgggaggcctaggcgggcagatcatgaggtcaggagatcgagaccatcctggctaacacggtgaaaccccgtctctactaaaagtacaaaaaattagccgggcgtggtggcaggcgtctgtagttccagctactcgggaggctgaggcaggagaatggcgtgaacccgggaggcggagcttgcagtgagtcgagatcacaccactgcactcaagcctgggcgacagagcgagactccgtctcaaaaaaaaaaaaaaagtctgacaaactctgtatcactactgtagacaaggaaaatggtgtcatggaactgaatatcttggtcatgagaagaaaccacagagttcatgactagaaacatgtactgtattcaaattttaataagctactatcttggcttttaaagttgtttttttttttgtttttgttttattttttaagacagaatctcgctctgtcacccaggctggagtgtggtggtgcaatcttggctcactgcaacctctgcctcccaggttcaagtgattctccttcctcagcctccccagtagctgggactacaggcatgtgccaccatgcatggctaattttttgtatttttagtagagacggggtttcaccgtgttagccaggatggtctcgatcttctcaccttgtgatccacccgccttggcctcccaaagtgccgggattacaggcgtgagccactgtgcccagccagcttttaaagttttaaaaaggatttgttcagacatggaatatatttgtgtatattacttgtgtgctgtacacacagaggaaatgtatgtttgtcatgtatgaagaatggcttcagtttctctgtaattaatttgtaattataataataaaacttagcttctcatc

SEQ ID NO: 118571 - DNA, 913 bp, Homo sapiens
  Payload ID: 3205
  Gene Symbol: C17orf75
  Gene Name: chromosome 17 open reading frame 75
  ENST ID: ENST00000583774
  CDS Start-End: 89-913
gtccgtttcagagtttttcgctttcgctggctgtgcttgcggagcactttgggtttcatttgtaaaggagccggagccccaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcc

SEQ ID NO: 118572 - DNA, 452 bp, Homo sapiens
  Payload ID: 3205
  Gene Symbol: C17orf75
  Gene Name: chromosome 17 open reading frame 75
  ENST ID: ENST00000583104
  CDS Start-End: 1-292
tcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcagaaatcctggatccaccaccgctgctgttcaccctctcccacccatcctgacccagacccagatgaaacaggccctaatgccagcccttcaggtcacttcctgaataaccaatggcttggaaaaagaaaaaaaatatttaatggaatctgtgctcaaataatatgttacaacaaaaatatacagaatgtacacaatacaaaaatacttaga

SEQ ID NO: 118573 - DNA, 776 bp, Homo sapiens
  Payload ID: 3205
  Gene Symbol: C17orf75
  Gene Name: chromosome 17 open reading frame 75
  ENST ID: ENST00000583221
  CDS Start-End: 71-298
gataccgacggctgcacgggagcaggggagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaag

SEQ ID NO: 118574 - DNA, 1642 bp, Homo sapiens
  Payload ID: 3205
  Gene Symbol: C17orf75
  Gene Name: chromosome 17 open reading frame 75
  Uniprot ID: Q9HAS0
  ENST ID: ENST00000577809
  CDS Start-End: 51-1241
agcaggggagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaaaaaaaaaa

SEQ ID NO: 118575 - DNA, 458 bp, Homo sapiens
  Payload ID: 3205
  Gene Symbol: C17orf75
  Gene Name: chromosome 17 open reading frame 75
  ENST ID: ENST00000582961
  CDS Start-End: 1-146
tggccatgacagaggagcagcataagtctgtggtcatcgattgcagcagctcccagcctcagttctgcaatgcaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaaca

SEQ ID NO: 118576 - DNA, 884 bp, Homo sapiens
  Payload ID: 3205
  Gene Symbol: C17orf75
  Gene Name: chromosome 17 open reading frame 75
  ENST ID: ENST00000580558
  CDS Start-End: 488-884
cgcccccggcccgccgcccggccttgcaccccacccccggcccagcggcccggccgctcctaaaagccatcttctcctctcccagccaagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacc

SEQ ID NO: 118577 - DNA, 733 bp, Homo sapiens
  Payload ID: 3205
  Gene Symbol: C17orf75
  Gene Name: chromosome 17 open reading frame 75
  ENST ID: ENST00000581747
  CDS Start-End: 469-733
ccagccaaggtctctggcctgaagggcgctcctcgcctcccgctgctcttcctggcccccgtcgtggacttattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggcca

SEQ ID NO: 118578 - DNA, 573 bp, Homo sapiens
  Payload ID: 3205
  Gene Symbol: C17orf75
  Gene Name: chromosome 17 open reading frame 75
  ENST ID: ENST00000583334
  CDS Start-End: 461-573
ggccgctcctaaaagccatcttctcctctcccagccaagattggcacagcaacgaggggacagtgaggacggaagcccaagtggcacaaatgcagaaactccctctggtgatgatttcagaatgtgtgtctttcatttgtcaagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagct

SEQ ID NO: 118579 - DNA, 1675 bp, Homo sapiens
  Payload ID: 3206
  Gene Symbol: C17orf78
  Gene Name: chromosome 17 open reading frame 78
  Uniprot ID: Q8N4C9
  ENST ID: ENST00000611038
  CDS Start-End: 108-587
aaacttggttccagctgcgtgtggtgaaagcaactagaggcagagctatcaagggctgtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagtatcaatgcctaggagccaggaagctgtgccaatgccagtggttgtggagatggcaaaagaagggaggccagccacctgggacagctgaatccaagcctgactctcagccccagaaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttc

SEQ ID NO: 118580 - DNA, 1862 bp, Homo sapiens
  Payload ID: 3206
  Gene Symbol: C17orf78
  Gene Name: chromosome 17 open reading frame 78
  Uniprot ID: Q8N4C9
  ENST ID: ENST00000615133
  CDS Start-End: 51-878
gtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagcttttttaccagggatctcacaatgtaaagtcctgggggcttcatcagagacttttcccaccactgccccttctataactcctgggaataaagaaggagagaaaactacaagtaccgacacagatgagaacctagagaagagacagaaatggagtattgtggtcaaaattctgattgctgtcaccctgttgctcagtggagttgccattatagtatttgtaatttttgaagtcccatgtccttatcaatgcctaggagccaggaagctgtgccaatgccagtggttgtggagatggcaaaagaagggaggccagccacctgggacagctgaatccaagcctgactctcagccccagaaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttcaa

SEQ ID NO: 118581 - DNA, 1862 bp, Homo sapiens; identical to SEQ ID NO: 118580
  Payload ID: 3206
  Gene Symbol: C17orf78
  Gene Name: chromosome 17 open reading frame 78
  Uniprot ID: Q8N4C9
  ENST ID: ENST00000616425
  CDS Start-End: 51-878

SEQ ID NO: 118582 - DNA, 1675 bp, Homo sapiens; identical to SEQ ID NO: 118579
  Payload ID: 3206
  Gene Symbol: C17orf78
  Gene Name: chromosome 17 open reading frame 78
  Uniprot ID: Q8N4C9
  ENST ID: ENST00000631822
  CDS Start-End: 108-587

SEQ ID NO: 118583 - DNA, 2163 bp, Homo sapiens
  Payload ID: 3207
  Gene Symbol: C17orf80
  Gene Name: chromosome 17 open reading frame 80
  ENST ID: ENST00000255557
  CDS Start-End: 371-2014
gcagccggtggcgagtacccctcagtcggacccgtaccaccactacttccggcgtctgctccgcgcccccccatgtcgctgccgccgtggtaccgccctctcgcggctgcgcagtggcaccatcccaaccgcaccgactggtaaccccgcccacgggaagaggcgggctcggagcgggaggagcgactaggagcttctgggagaaaggacctcccctggggtggcagaagcgctcgcctgttcacagccaacggagggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaaggctggatcaggtgcaacaccaccataaggaagagtggattcggtggcatcacgatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatct

SEQ ID NO: 118584 - DNA, 3449 bp, Homo sapiens
  Payload ID: 3207
  Gene Symbol: C17orf80
  Gene Name: chromosome 17 open reading frame 80
  Uniprot ID: Q9BSJ5
  ENST ID: ENST00000268942
  CDS Start-End: 195-1916
ggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaactgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaacgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttatta

SEQ ID NO: 118585 - DNA, 3645 bp, Homo sapiens
  Payload ID: 3207
  Gene Symbol: C17orf80
  Gene Name: chromosome 17 open reading frame 80
  Uniprot ID: Q9BSJ5
  ENST ID: ENST00000359042
  CDS Start-End: 210-2039
ctgacgaggttccttggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaactgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaacgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgt

SEQ ID NO: 118586 - DNA, 2075 bp, Homo sapiens
  Payload ID: 3207
  Gene Symbol: C17orf80
  Gene Name: chromosome 17 open reading frame 80
  Uniprot ID: Q9BSJ5
  ENST ID: ENST00000426147
  CDS Start-End: 170-1921
ggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaat

SEQ ID NO: 118587 - DNA, 2129 bp, Homo sapiens
  Payload ID: 3207
  Gene Symbol: C17orf80
  Gene Name: chromosome 17 open reading frame 80
  Uniprot ID: Q9BSJ5
  ENST ID: ENST00000535032
  CDS Start-End: 114-1943
gctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataa

SEQ ID NO: 118588 - DNA, 542 bp, Homo sapiens
  Payload ID: 3207
  Gene Symbol: C17orf80
  Gene Name: chromosome 17 open reading frame 80
  ENST ID: ENST00000585109
  CDS Start-End: 215-542
attatgtcataataatatcatacaagtatttgagttgaatccgtgtaacatattttaaaacaggcggacctatccggcagtggtgcagacggcctgacgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagata

SEQ ID NO: 118589 - DNA, 1144 bp, Homo sapiens
  Payload ID: 3207
  Gene Symbol: C17orf80
  Gene Name: chromosome 17 open reading frame 80
  ENST ID: ENST00000582391
  CDS Start-End: 605-1144
gctctgtggggagcttgcaagggcgggtttgttttccgcggcccacgttctaagtctgggggagactctcctgagcggagagggtagggaatcgggtgccggggccggcggagggtcttcctggaaccgcaggaggaaatcctcggtggggctgcgggaacggctgtccctgacccaggagctgccgggccgaccccatccactccgcagaatcagaacagctggcagaatcagaacagctttcagggaaaggaagggtgcggggaggtgggcaggctggtaacgcagcgggaggagggaaaggcggctggagagcgccggaggtgagggtgaggattagtggaactattgaggtcctccttgagcccggaggctggggaggtcttaactctctgctttccggaacctgtgtttctatttggttcagtatcgtgccgcgtttactcactgtgcatgctgccaagtcacctgtctgatcgtgtcctacacaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaacct

SEQ ID NO: 118590 - DNA, 531 bp, Homo sapiens
  Payload ID: 3207
  Gene Symbol: C17orf80
  Gene Name: chromosome 17 open reading frame 80
  ENST ID: ENST00000582793
  CDS Start-End: 181-417
attcacgtttcattctgccacactcgggaacggtgatcggggaagcatggggatccgggagaagcacccacaaaactagcatcctcctggaggagctcggtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggata

SEQ ID NO: 118591 - DNA, 2049 bp, Homo sapiens
  Payload ID: 3207
  Gene Symbol: C17orf80
  Gene Name: chromosome 17 open reading frame 80
  Uniprot ID: Q9BSJ5
  ENST ID: ENST00000577615
  CDS Start-End: 139-1860
ctcgcctgttcacagccaacggagggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatca

SEQ ID NO: 118592 - DNA, 615 bp, Homo sapiens
  Payload ID: 3208
  Gene Symbol: C17orf89
  Gene Name: chromosome 17 open reading frame 89
  Uniprot ID: A1L188
  ENST ID: ENST00000431388
  CDS Start-End: 126-350
aaagcctggccaattaagaagttcaggaaaggttatgggcggaagcgccgacctatcaagctgtttgacaccggaagaggacggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgca

SEQ ID NO: 118593 - DNA, 365 bp, Homo sapiens
  Payload ID: 3208
  Gene Symbol: C17orf89
  Gene Name: chromosome 17 open reading frame 89
  ENST ID: ENST00000576002
  CDS Start-End: 1-239
gcggccgcctgagtaaggacttctgcgcgcgggagttcgaggccctgcggagctgcttcgccgctgcggtaggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 118594 - DNA, 3719 bp, Homo sapiens
  Payload ID: 3209
  Gene Symbol: C17orf96
  Gene Name: chromosome 17 open reading frame 96
  Uniprot ID: A6NHQ4
  ENST ID: ENST00000613024
  CDS Start-End: 927-2066
taggggccattcacggcccgctagaatccctgctgtgcaaagcttgtaaacaaccattgcctcatttcatctttcccctaaacattatttctgagattcatctacgttgattcacatagctcttttagtcccaagagggcagatatgaaccgtcccattttacagatgcaaaaccgtgactgctcgggaaaaaacgagtggctttgcgacgacgaaatcccaggacgccaccgggccacgtgcggcggcgcatctggccgctcgcgatcccacccgcgcacgctccctcccgcgctccctcccagccgccgccgcgccgggtccacgtgtgtgtgtctgtgtgcggaatggggacgggggcggtgccgccggaggggtggggtccgggctaacgtcacgggcggtgcggcccaatcagcggcgggctcgcggccccggcgctggtattggggcagcgagggggcagttctctataacgcggtctccgggagccagcggggaagaaagaaaccgagcgggcggaaggcgccctccccgccgcctgggcccgggcaccgggtgccgggcccggggtccttcccgcctcccgcggccgccggccgctttgtttcccctgcctctgcgcttcgggcgactcgagagggtctcccgccggggttgcgaaggggacgcggcggcagaagggcggccgaccccgccgggactcacagggacccaggagtccggccgccgggagggccgcgtgaggagagcgaagagggagcccgagctctgcggccccgggtggcgggccgggggcgcccgtgagcagagacctccccgtcgacggggggcgatgttcccctcacccgtgggctcttcgggcagccagggcatcccgccgctgggacctggacccgctcagtgggcacccctcaggctgctccatggagaccctgtgccctgcgccccgcctggcagtgccggcgtccccgcgagggtcgccctgctcccccacgccccggaagccgtgtcgggggacccaggaattctctccgctgtgcctgcgtgccctcgccttctgcgcccttgccaagccccgggcgtcctctctgggcccggggcctggggagctggcggcgcggtccccagtgctgcggggccctcaggcccccctgcgccctggcggctgggccccggatggcctgaagcacctctgggcaccgaccgggcggcccggcgttcctaacaccgccgccggcgaggatgcggacgtcgcagcgtgcccccgccgcggagaggaggaagagggcggaggcggtttcccgcacttcggcgttcgctcctgtgcacctccgggccgctgccctgcgcccccgcaccctcgggaatctacgaccagcttcgcctcggccccgcctcgcccggccccgggtctcgagcctcagcgtggcccagccgccagcccgcctcaggaacccagttcccggcctccgtcgccacctgcgggcctctccaccgagcccgcgggtcccgggacggcgccgcggccgttcctgcccggccagcctgccgaagtcgatggaaaccccccgccggccgcccccgaggctccagcggccagcccctcgacggccagcccggctccggccgcacccggagatctccgccaggaacatttcgatcgtctgatccgccggtcgaaactttggtgttacgcgaagggcttcgccttggacactccgagtttgcgccgggggccagagcggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaagtgcttactttgcctggggaaggggctagacactgtcccagggaaagtaatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggacccagtgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgttttaaaaa

SEQ ID NO: 118595 - DNA, 3719 bp, Homo sapiens; identical to SEQ ID NO: 118594
  Payload ID: 3209
  Gene Symbol: C17orf96
  Gene Name: chromosome 17 open reading frame 96
  Uniprot ID: A6NHQ4
  ENST ID: ENST00000621654
  CDS Start-End: 927-2066

SEQ ID NO: 118596 - DNA, 1839 bp, Homo sapiens
  Payload ID: 3210
  Gene Symbol: C17orf97
  Gene Name: chromosome 17 open reading frame 97
  Uniprot ID: Q6ZQX7
  ENST ID: ENST00000360127
  CDS Start-End: 17-1288
agcaggggtggtcgccatggagacgcgtggccctggcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccaccccgaccccgacgccctcaagggcttccaccccgaccccgaggccctcaagggcttccaccccgaccccgaggccctcaagggcatccaccccgaccccgaggctctcaagggcttccaccccgaccccgaggccctcaagggcttccaccccgaccctgaggccctcaagggtttccacactgaccccgaggccctcaagggtttccacattgaccccgaggccctcaagggcttccaccccgaccccaaggccctcaagggcttccaccccgaccccaaggccctcaagggtttccacactgaccccgaggccctcaagggcttccaccccgaccccaaggccctcaagggcttccaccccgaccccgaggccctcaagggcttccaccccgaccccgaggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaataagtgggttccagaactccatccctgggaagttaccatgggaagtcccaagaggaatactgcttctttcataaacatggtcctctcctaa

SEQ ID NO: 118597 - DNA, 878 bp, Homo sapiens
  Payload ID: 3210
  Gene Symbol: C17orf97
  Gene Name: chromosome 17 open reading frame 97
  ENST ID: ENST00000491373
  CDS Start-End: 1-630
ggcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacgatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaaca

SEQ ID NO: 118598 - DNA, 736 bp, Homo sapiens
  Payload ID: 3210
  Gene Symbol: C17orf97
  Gene Name: chromosome 17 open reading frame 97
  ENST ID: ENST00000571106
  CDS Start-End: 7-468
gtcgccatggagacgcgtggccctggcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgggatcttgctctggggaaagccagctgcagtgttgtgtgggctgcctgaggaaaggtgccctccggaaagaaatgatgtctccgcccaacagcatggtggacctgagtcctgctaccagccacatgagtgtgcttggaagcaggtggagcccagttgagccttgaggtgcctccctctgtgagagaccccaagccggagacatccggccaagaggcacccagattcctgccccacagaaactgatacaataacgttgtttaaagccactacatttggaggtaatcttgttacacagcaataactgactaatacagtcggcctcttccatcagtcacgattctcagtgagttgtctcgcccttaatctgagggctggaaagcccgaaacccaacattgtcgtaagaaactgcgttacccaagacacc

SEQ ID NO: 118599 - DNA, 499 bp, Homo sapiens
  Payload ID: 3210
  Gene Symbol: C17orf97
  Gene Name: chromosome 17 open reading frame 97
  ENST ID: ENST00000575151
  CDS Start-End: 1-21
gctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagatgaatagccttggaagatagagatcgtgtctccctccagagcaaagggcagattagcttcaatgatgacagaagatctcggttcccgggctcagagctccgctgctgtaacgtaagcccttctgtcctcatgtcacctagagcctcttcctgtcaccctgtgggaagtgattctgaggaaaccaggacaattgcaaacactctggctactgctttgctgtgactaataaacatccttt

SEQ ID NO: 118600 - DNA, 632 bp, Homo sapiens
  Payload ID: 3211
  Gene Symbol: C17orf98
  Gene Name: chromosome 17 open reading frame 98
  Uniprot ID: A8MV24
  ENST ID: ENST00000614158
  CDS Start-End: 67-531
aggggtgtccccatctagggtcctcatcccccaccagaaaggccctccgaggctacggtggttgggatggcgtacctgagcgagtgtcgcctgcgactggagaaaggctttatcttggacggggtggctgtgagcaccgctgcccgcgcttatgggcgctctaggcccaagctgtggtcggcgattccgccctacaacgcgcagcaggactaccacgcccgcagctacttccagagtcacgtggttccgccccttttgcggaaaactgatcaggatcatggcggtacaggaagggatggctggatagtagactacatccacatcttcgggcaaggacaaagatacctcaacaggagaaattgggcagggacagggcattctctccagcaggtgactgggcatgaccactacaatgctgatctgaaaccgatcgatgggttcaatggaaggtttggctaccgcaggaacactccagccctccgtcagagcacgtccgtcttcggagaggtcacccacttccctctgttctaacagcatcttttcccttcatagccatcgacctgaatttctaagacaaatgtttagatgaactcttagtgttattttacgttaaaaaaattaatttgtgtctc

SEQ ID NO: 118601 - DNA, 632 bp, Homo sapiens; identical to SEQ ID NO: 118600
  Payload ID: 3211
  Gene Symbol: C17orf98
  Gene Name: chromosome 17 open reading frame 98
  Uniprot ID: A8MV24
  ENST ID: ENST00000619585
  CDS Start-End: 67-531

SEQ ID NO: 118602 - DNA, 984 bp, Homo sapiens
  Payload ID: 3212
  Gene Symbol: C17orf99
  Gene Name: chromosome 17 open reading frame 99
  Uniprot ID: Q6UX52
  ENST ID: ENST00000340363
  CDS Start-End: 56-853
gccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgctgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaa

SEQ ID NO: 118603 - DNA, 568 bp, Homo sapiens
  Payload ID: 3212
  Gene Symbol: C17orf99
  Gene Name: chromosome 17 open reading frame 99
  ENST ID: ENST00000591995
  CDS Start-End: 1-568
cttatcgcccttacctctcttacagctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgctgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttct

SEQ ID NO: 118604 - DNA, 694 bp, Homo sapiens
  Payload ID: 3212
  Gene Symbol: C17orf99
  Gene Name: chromosome 17 open reading frame 99
  ENST ID: ENST00000586029
  CDS Start-End: 1-454
ccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgctgggcgtcctccacctcaggtgcccatgtggacagtgccaggctacagatgcactgggagctgtggtccagacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgt

SEQ ID NO: 118605 - DNA, 703 bp, Homo sapiens
  Payload ID: 3213
  Gene Symbol: C18orf21
  Gene Name: chromosome 18 open reading frame 21
  ENST ID: ENST00000269194
  CDS Start-End: 372-703
ccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctgtaagaggactggaggggaagcgggaggcgagcggatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatc

SEQ ID NO: 118606 - DNA, 958 bp, Homo sapiens
  Payload ID: 3213
  Gene Symbol: C18orf21
  Gene Name: chromosome 18 open reading frame 21
  Uniprot ID: Q32NC0
  ENST ID: ENST00000333234
  CDS Start-End: 288-686
gggccaagcccgctacctcctgtaagaggactggaggggaagcgggaggcgagcgggtaggtgttcctttgctcctcacaagtctctttctcttttacagctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattga

SEQ ID NO: 118607 - DNA, 1581 bp, Homo sapiens
  Payload ID: 3213
  Gene Symbol: C18orf21
  Gene Name: chromosome 18 open reading frame 21
  Uniprot ID: Q32NC0
  ENST ID: ENST00000592875
  CDS Start-End: 647-1309
tggtgcttgcacaacattgtaaatttactaaacgccactgaattgttcaccttaaaatggtcaatattacgttatgtgaatttcactttaattacaaaaagagaaacgctagcgtttacgcaggcggagggcaggctggactggggacgctcctcccggccgcctcgttgctggcagcgcttccgcccgccggcgcaccagtcagtaccgcgcccggcgaatgtggagggcgaagctgcggcagggcaatcacaaaagggctgtcagagaggaggcgaggcgggaggaagatggagaggcgggtgggagcctcacctttggactctatcgccacagcccggtctagccgctacgcccgagctcaagtctgactcgaaactccgctgggtgcctgagaggacccggcaggccaaggggtggaactgagggggcggggacgcggcgggcgggtggggccgcctcccggctgggcacgcctccaagccagactggacgcgaaggaaaccggaacctgtctgcctacggtgcctgtttccggaagcagcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattga

SEQ ID NO: 118608 - DNA, 656 bp, Homo sapiens
  Payload ID: 3213
  Gene Symbol: C18orf21
  Gene Name: chromosome 18 open reading frame 21
  ENST ID: ENST00000587873
  CDS Start-End: 391-656
ttttctcacctggttcccgcggcgagccagcggcagcggcggcggcgatgagacagaagcactaccttgaggctgcagcgcggggactgcacgacagctgcccgggccaagcccgctacctcctgtaagaggactggaggggaagcgggaggcgagcgggtaggtgttcctttgctcctcacaagtctctttctcttttacagctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctc

SEQ ID NO: 118609 - DNA, 1059 bp, Homo sapiens
  Payload ID: 3213
  Gene Symbol: C18orf21
  Gene Name: chromosome 18 open reading frame 21
  Uniprot ID: Q32NC0
  ENST ID: ENST00000610527
  CDS Start-End: 381-779
agcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctgtaagaggactggaggggaagcgggaggcgagcggatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggc

SEQ ID NO: 118610 - DNA, 856 bp, Homo sapiens
  Payload ID: 3213
  Gene Symbol: C18orf21
  Gene Name: chromosome 18 open reading frame 21
  ENST ID: ENST00000618334
  CDS Start-End: 105-497
agcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggc

SEQ ID NO: 118611 - DNA, 668 bp, Homo sapiens
  Payload ID: 3214
  Gene Symbol: C18orf25
  Gene Name: chromosome 18 open reading frame 25
  ENST ID: ENST00000587591
  CDS Start-End: 231-668
agatattggtgccgctgcccgagaagagctcagccgagtctccccgagcccagctatcggcatccgcgaaaaagcggggagagaagggcacgggctctccgctggagcgactctgggattcagacaccgcaagctgctttcggaagggcttcaggagggggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaa

SEQ ID NO: 118612 - DNA, 586 bp, Homo sapiens
  Payload ID: 3214
  Gene Symbol: C18orf25
  Gene Name: chromosome 18 open reading frame 25
  ENST ID: ENST00000588730
  CDS Start-End: 277-586
agatattggtgccgctgcccgagaagagctcagccgagtctccccgagcccagctatcggcatccgcgaaaaagcggggagagaagggcacgggctctccgctggagcgactctgggattcagacaccgcaagctgctttcggaagggcttcaggaggggaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccagatggacctccagttgtagctcattatgatatgtctgacaccaactctg

SEQ ID NO: 118613 - DNA, 2329 bp, Homo sapiens
  Payload ID: 3214
  Gene Symbol: C18orf25
  Gene Name: chromosome 18 open reading frame 25
  ENST ID: ENST00000615553
  CDS Start-End: 316-1143
ggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccagggacggggttctgttatgttgttcaggctggcctcagacgcctgggcttaagcgatctgcacaccttggcctctcaaagtgctgagattctgtgggattcgcacctggcctaaaacataggtattaatagttatattcaagagttttgctcttgttgcccaggctggagtgcaatggcatgatctcggctcactgcaacctccacctcccaggttcaagtgattctcctgcctcagctacccgagtagctgggattataggcgcctgccaccatgcccggctaattttctgtatttttagtagagataggggttcaccatgttggccaggctggtctcgaactcctgacctcaggtggtccatccgtcttggccccccagagtgctgccacagcgctcagtctgatttatttcttaaaagttgtatgcagaatgatttaaagtgtattaagtctgcttgttaatgaaagaaacaatatagtgaattcttttttaaccaaagtaccctaaattgatattactggtaatttttatttttaacatatagctgactttgcctaaaggtatacagttacatgaatgttataagaaagatggcaaacaggctttgtgttatcatttgtttaaaatagcaaattatgggcaagttatcttacaaaaaggtagccttttaaattaattgtaccttttatattttatttagcttatgttgattttcatctccccttttaaaaaattatttaaatagtacagtgagggtgaaatgaaaaagattttgtggaatgccacatgtcagaaaatacagtgtcaaaacaatttcagtaaattttttttctcaaaatcctcttcaaaaataccatatgcccttaatcctagtacagataaaaaacatgtcattttaatttgtttagaagttacgagattgtgaattgtaagtaacagggaataacttccaagtttctttactcatttttcccccgatttctatttttatttcctctgaagtttaggaaagttagtggaagttgcaaccaaactgtttgtttgctagtattgagtagatattctcatgttgtattaaattaccacagtgtaaaatagaagatgtcataaaaagtgaaggaataatccacaaagaagtgtattctatggcaattaagtcttattcctaatataactttaagatttgggaagaatgttatgaaattactgtttttattttattgcattttcttaatatccttttcctcactgtgcatttgacatgtaacctagatgaataaaaattttgaaaaagaaa

SEQ ID NO: 118614 - DNA, 5264 bp, Homo sapiens
  Payload ID: 3214
  Gene Symbol: C18orf25
  Gene Name: chromosome 18 open reading frame 25
  Uniprot ID: Q96B23
  ENST ID: ENST00000619301
  CDS Start-End: 368-1399
agtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttgttctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtattt

SEQ ID NO: 118615 - DNA, 5462 bp, Homo sapiens
  Payload ID: 3214
  Gene Symbol: C18orf25
  Gene Name: chromosome 18 open reading frame 25
  ENST ID: ENST00000615052
  CDS Start-End: 375-1589
gggcggaagtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttgttctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaacaatg

SEQ ID NO: 118616 - DNA, 1128 bp, Homo sapiens
  Payload ID: 3215
  Gene Symbol: C18orf32
  Gene Name: chromosome 18 open reading frame 32
  Uniprot ID: Q8TCD1
  ENST ID: ENST00000318240
  CDS Start-End: 213-443
gtcagctgcgtttccgcggtcgcgggtgagtgtgcccgggctagcggcctgggttgggctttgtagctgctccgcaggcccagcccgggccgcgctcgcagagtcctaggcggtgcgcggcctcctgcctcctccctcctcggcggtcgcggcccgccggcctccgcggtgcctgccttcgctctcaggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactgg

SEQ ID NO: 118617 - DNA, 714 bp, Homo sapiens
  Payload ID: 3215
  Gene Symbol: C18orf32
  Gene Name: chromosome 18 open reading frame 32
  Uniprot ID: Q8TCD1
  ENST ID: ENST00000582392
  CDS Start-End: 205-435
tggagcgaataattaaaataataatatctcgtagccaccttctagacttttctgacccagtttccatatgtgtgaagtaaaatatcttaccgaagtattattatgaagattaaaagataagatacaaataggcttcattccgaagagagctaaaaagtctcttaaaagccgtaattgtggcttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagta

SEQ ID NO: 118618 - DNA, 5395 bp, Homo sapiens
  Payload ID: 3215
  Gene Symbol: C18orf32
  Gene Name: chromosome 18 open reading frame 32
  Uniprot ID: Q8TCD1
  ENST ID: ENST00000613385
  CDS Start-End: 70-300
ccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactggtagttcattttcttttaaagtctattgaaatattcaaaagggaaatttttcaccacgtcagaaggcagaatttggatgttgtgatggcatctgtgtagtggtgggacaacaattactattgttgcgtaacaagacactccaaaatttagtggttttcagcagcagtgactcgactgggcagttctttgctgttctgggctcactcatatggctggctgggcctgggtctggacctgggccgctatgtgatttttatcttgggctttgaaaattcagtgtagggacctataaatattcaaagatgatgagatgcatccttatatattttttgtattcactctgaagctgggaaagattaaaaggaactcctgcccttgggtccctaatgaagtctgggtcctaactcaggctctattaagttctgtggctggtcaagtcactgatttaccttgggctttatttgatataaatcatgtaaatcagcaggtctcagcttttctgtccaaagccacctgagggataagataaattctcattagcaaataaacttttttaaggtataaatactattataaaaataacagatatttacagtacaacaatgcaagaggatcctaaatgaaaagcgaatgttttttctcaactctcattcccttattccagctccacagaggtaaccaattgtttttttgttgttgttgttgtatggtttgtttttgttagacagtagtcttttcctgaacagtgctgctccttgtggagcaaggctaattcataggcagtgcatccagagtccgccccagttgattttgtgtgtaaccttctagcaactttttgaaaattaatttgttcttaaatatgcacatcatttttatttatttatgtttttgagacagggtctcactctgtcactcaagctggagtgcagcagcatgatcacggctctctatggcctcgacctgcagtcctgaagtgatcctctcaccttagcctctcaagtagctgggactacaggtgcacaccaccatgcccagctaatgttttttgtaattttttttatagagacagggtttcgtcatgttgcctgggctgatctcgatctcctgggctcaagcgatcctccactttggcttcccaaagtgctgggattacaggcatgagctactactgcacctggcccacacatcatcttttaaaaattaagtaatattgcaacgtttctaattgtccctacttctttgctcctcaaaggttttacctactgagctgtgggctttttaaatttatctccatatttataaataaattataaaaatataaaaatataaacattttattttttgagacagggtctcactgtcacccaggtgctggagtgcagcggcatcatcatagctcactacagcctccaactcctgggctcaagtgatcctcccacctcagcctcctgaattgctaggactacaggtgtgtgccaccacgcctggctaattttttgtagagacggggtcttgctctgttgcccaagcgagtctcaaactcctggcctcaaagtgatcctcttgcctcagcctcccaaagtgtcgggattacaggcatgagccactgcctggctatactgttatattttgagccatcaacttcagacattgtttcccataatggttgagatgccgctatcttacactgcctctgctcctcccacacatcctcccaagtgcttttgtaaattttgcttacatcatcagtgttcatagcatgagtgtgccaggtgtctttcatttgcccctcccaagtctctgctcccctcatcctgctttcagcccaaggaagctgtatagacatcaacagacttcccatgtctctgggttctgctgggtttggccaatagcgatccatagcaggagatggctggagggaggagaatgaaggcagagtgtttattcccttggccctctctctgcaaggtcacctcaggccaactgttcctcagccagaagtcactgtgcctcaaggaacactccaggcagccaactccacctgacttcttttatttttcctaacctgtccttcaccctgcccttttgggcccaggggtggtggtatttctgttactggctctgggctactgcttcctctcaagagtgctatctggcttgctgggacactgcctgggagaatactattgctcactgcacaggttaatgcactgtgattgcgtcccttttaatatacaggtggtgtcttcctggagtgaccagtttaccttctccccatacacctctcctgcctagttgttgcctagacctggtgcacactgcagtcctcgggactttctgttgccaccctcctgtattggacgtcttgtttctggatttcctatcctcttccttcttggtttatccctcattttttctgtagcacagcagttttctaattcaatacttttaggaggttgagtatggataattttggaaagtgtccccgggatgattccaatttatttaagcctgttttccagagagctgcgggtctcctaaggcctttctcatttctaacaagtctccctctctagaacactggttcccagtcgttgttttcatactagcaacattttaaaagcaggataggggtggctagtatgcaattgccaacttttgatttttccaagcaggagtatatcaaaaagctacaatttattaccagtatttcgtaaaagacagtttgacaccagaagagtgaaaaagaacatgggaatagtggacaaaaatagccatcagtttgaataagcgtatgaaaagtgttaattttatgaaaaattcactattttgttcatatttttcttattttggaggctaattgttaaaagcttttatcagttatccatgggctggagttggtagccactgtttgataccacacaaatgtttctttgccctaaaatatcaacatctgtctgtgtaaaggtcagggctgcctttttagtaagagctaccctttgttaaacacattgtacctgcactgttcatgggtgtttcacacacacaaacctacctggtctgcataaacctgaaatacagtcaagaaaacaggatccaccggaggcggtgactcaagcctataatcccagcactttgggaggccgaggtgggaggatcacttgaggccgggagttcaagaccagcctggccaacatggtgaaaccctgtctctactaaaaatacaaaaattagtcgggcatagtggtacacacctgtaatcccagctactccagaggctgaggcatgagaatcgtttgaaaccaggaggcagaggttgcagtgagctgaaattgtaccactgcactccagcctaggtgacagagcaagactgtctcaaaagaaaagaaaaagaaaaacaggatcccagcctgggcaacatagggagacctcgcctccaccaaaaattaaaaaatttagctaggcatatggtgatgtgcacctgtggtcccagctactctggaggctgaggtgggaggattgcttgaacccaggaggttaaaggctacagtgagctgtgatcaagccactgcactctagcttggacaacagagcaagaccctgtcttaaaaaaagaaaaaaagaataatggagtttaaatatgtaaatgacaagtctaagatttcaaggtcatactttcatgctaaggagccatcacagctacatatatatatagtgtatatatatatatagtgtgtatatatatatagtgtatatacatatagtgtatatatatatagtgtatatatatagtgtgtatatatatagtgtgtgtatatatatatatgtgtatatatatatagtgtgtgtatatatatatatttttgtttgtttgtttgtttttggaagatggagtttcgctcttgttgcccaggctgcagtgcaatggtgcaatctctgctcaccacaacctcctcctcccaggttcaagcgattctgcctcagcctcccaagtagctgggattacaggtgcgtgctaccacacccggctaattttgtactttagtagagacggggtttcaccacgttggtcaggctggtctcaaactcccaacctccagtgatctgcctgccttggcctcccaaagtgctgggatcacaggcataagcactgggcccggctgccacagctactaatatcttaattgttagtaataccttattgggaataattaggcagaaatggagagggtgagtttagattaatcagtatgtgtgaacttgttttaaagtttctggaggctgaggtgagaggatcgcttaagtccaggaggcggaagttgcagtgagccaagatcacaccactgtactccagccaggacaacagagcaataccccgtttcaaataaataataataaagttaattttgct

SEQ ID NO: 118619 - DNA, 575 bp, Homo sapiens
  Payload ID: 3216
  Gene Symbol: C18orf42
  Gene Name: chromosome 18 open reading frame 42
  Uniprot ID: P0CW23
  ENST ID: ENST00000434239
  CDS Start-End: 173-382
agctgcggccccaggatctagcggcgggagctgtccggggtgctgaccgccccgcccgccgcccgcccagcgcgccctcctgcaccggaccccgccaagtccggccttcttcccatcctccgtctgcctgtctttctctcttaatctgggggcgtagcggctggaagaaatcatggtgttcgctccaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatg

SEQ ID NO: 118620 - DNA, 523 bp, Homo sapiens
  Payload ID: 3216
  Gene Symbol: C18orf42
  Gene Name: chromosome 18 open reading frame 42
  ENST ID: ENST00000580650
  CDS Start-End: 16-246
acaaatctatcttaaatgtcagtccaatatccacggcgacgagccacagcaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttatttttaaagttct

SEQ ID NO: 118621 - DNA, 5237 bp, Homo sapiens
  Payload ID: 3217
  Gene Symbol: C18orf54
  Gene Name: chromosome 18 open reading frame 54
  Uniprot ID: Q8IYD9
  ENST ID: ENST00000300091
  CDS Start-End: 333-1451
tgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagaaattttaataagatgtttcagatctttgagtatgaaaaacataacaaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttact

SEQ ID NO: 118622 - DNA, 4056 bp, Homo sapiens
  Payload ID: 3217
  Gene Symbol: C18orf54
  Gene Name: chromosome 18 open reading frame 54
  Uniprot ID: Q8IYD9
  ENST ID: ENST00000382911
  CDS Start-End: 333-1934
tgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtaggctgaaaaacccaaaacttatgaataggactaataattgcatttctgaatcatctttgtcttttcccaagaaatcgtctttcaaggacagttcagaacacagtcttgaaaagaattacccaagatggctcactagccagaaatctgaccttaatgtttcagggataactagtatacctgatttcaaatacccagtctggctgcacaatcaagacttgctacctgatgcaaatagtcaaagggtttatcagatatttaaagatgatcagtgttcccctagacatagtcatcaggcacaaggaacttctcggcttatcaataaattagattgttttgaatatgcttttgaaccctcaaacttttcaaattccttgagtgatgataaagaattagttaatgaatacaaatgtgattttgaacatagccagtgtcaatgtgagaatccacttctcccaggacaatccacaaagccattcagtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattg

SEQ ID NO: 118623 - DNA, 389 bp, Homo sapiens
  Payload ID: 3217
  Gene Symbol: C18orf54
  Gene Name: chromosome 18 open reading frame 54
  ENST ID: ENST00000579594
  CDS Start-End: 1-108
gaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaaaacatttttggtagaagtgctatccagaagtgaacttgtcaaaagctctggccaagtattttatttcgtccctaaacattctaactatccaccaaactggggccctctgatccatccaaaaagcccggcatcaggaaagacaatttcaaaactgaagtttgattttgggaagcctattaaatatgttagaagttcaaacca

SEQ ID NO: 118624 - DNA, 776 bp, Homo sapiens
  Payload ID: 3217
  Gene Symbol: C18orf54
  Gene Name: chromosome 18 open reading frame 54
  ENST ID: ENST00000578138
  CDS Start-End: 133-588
gcggtttgaaagcgagcgcgggtgtcgagctctgctgtgactgcggaggaagctgcgagtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgc

SEQ ID NO: 118625 - DNA, 5693 bp, Homo sapiens
  Payload ID: 3217
  Gene Symbol: C18orf54
  Gene Name: chromosome 18 open reading frame 54
  Uniprot ID: Q8IYD9
  ENST ID: ENST00000620105
  CDS Start-End: 303-1904
gcggtttgaaagcgagcgcgggtgtcgagctctgctgtgactgcggaggaagctgcgagtgagccgagcctgaggcggggcggtgtccgggttggggatgctttgtggtgtctcgcgttgggtaacaggcctgagctttcggcggagagctgtggaagtttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtaggctgaaaaacccaaaacttatgaataggactaataattgcatttctgaatcatctttgtcttttcccaagaaatcgtctttcaaggacagttcagaacacagtcttgaaaagaattacccaagatggctcactagccagaaatctgaccttaatgtttcagggataactagtatacctgatttcaaatacccagtctggctgcacaatcaagacttgctacctgatgcaaatagtcaaagggtttatcagatatttaaagatgatcagtgttcccctagacatagtcatcaggcacaaggaacttctcggcttatcaataaattagattgttttgaatatgcttttgaaccctcaaacttttcaaattccttgagtgatgataaagaattagttaatgaatacaaatgtgattttgaacatagccagtgtcaatgtgagaatccacttctcccaggacaatccacaaagccattcagtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagaaattttaataagatgtttcagatctttgagtatgaaaaacataacaaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttactcat

SEQ ID NO: 118626 - DNA, 5127 bp, Homo sapiens
  Payload ID: 3218
  Gene Symbol: C18orf63
  Gene Name: chromosome 18 open reading frame 63
  Uniprot ID: Q68DL7
  ENST ID: ENST00000579455
  CDS Start-End: 330-2387
gggctgtgaggagggcacgaggggacactccgatgaaggcagggcacgcggggcgagccgggagcgtctcctgagggcagcgaggagggagctgaggcacgcgggctctcaatcgacgccccacagagaccaagaggcctggccttggggggcagctgcttgaaggaggcagagcggaagcgagggagactgctggaggccctgccgcccacccgccctttcctccccctgaggagacgcctgacgcatctgcagtgcaggaggccgtgggcgttagaagtgttgcttttccagtttgcctgattgctgagacactcagtcaggaaagtatgaatgattctaggcagcagtctctgttcttcatcacacttccagatttaaacaaactctgtgctgtcagaataatactgagtaataaggtggcagatactgagattaggactatacaaatgaagatgtgcaggcaattgctgtttttgcatcaagatattcttacatcacctgtgtctggaatattaaaccaaatctgggtggtgatggcgataccattttataaagcaagaaaacttaatgcctatgttgaaaaatatggagctaagatggaggctccacaaagagtaattcctgtaattcttcagaactgcctgtcatattcattcatggctagacttgctccagcctggaatagaactggtcatctcttgatacaaggaagagattttctttctcagatgggaaaacaaagtgctgttgtattaaacatcaatgtaacagaaactcaagtttgtctaagtatagaagcttgcacaatcagactgccagcacctgagctaaaagagtttgagatttcccagagtattataaaggattttcatgctaacaagcatgctgtcattgagagacattccattttaagcaactggtgctacgttttgccaagtatgaaaatgggacaaattataaatatttttcatgccatccccgctgcctgtccttttcactcatatggagatttccagagacactgggatgccctgtatggctataaacttccaggtgattgtggaaaaattaaaatatactgcaacatctatttcaaaatgctcggagaaaggaccttcacatatcctctcagttgcatcagaagtcagcccatgcagttctttccaagggtagattcggaagttgtgttgaaaagttttctttcagatttaaaatctaaactgccccatatatgtggatttcccataaagatgacaagtaaaccatgctactacacacaagaactaactaaacctaatatacaggaacacaaagtcaagccacccaatttgaccactaaaaaaatgcttagggcatctctgactcaagccacttccagaaagcctgcctgtgctcaaagtcttctaccatgttcagtagcagtggaccacaaggtggagctttcagtcagccagccaacatcaggcattttctcagctttgcatctccagccagagtctgttcagggtagaaagaaatccctgtctatcagggctccacaagtacattcagaagtattaatgcccaacagaggaaatactcaagttcagcacacaaatcttagctcccaaagcaacatcacccctaagtttgtaccagttttcaaaaatagattgttacaaatgaacaaaaatacctcagtacttggcagcccaaaaagaaaacagcatgatgtgacacaatctaaattgttttcactcaaaactagtatgatccagcatgacaaactgaatttaggtccagctataaaaaaccgttatagtagtaacattcagatgcaggctgctaacaatttaaatcaggagaattccagacctctgcaagaaaaaaatacagagtcttctgaaaatatgacaaaatttccctcttctcgtggaaaatcgactgtgagtttaaacaaaaataagcaactatctaatagtgcagtatttgtggtgtcaaataacaatttaggggtggtaaaaagtgctgttgacttccaaatgaaaggaaaagaaaatttaacaggcaaaggtataacacaaattttagggaaaagccatgggtcactaaaactgaaaagacagccacacatttttgaatcagatggagaaaccgaagatccacgactgctacagcagcaatcagaaaatcaagctaaagaagttggtacaagtgaccacaggttgatagtaagcaaaatagcccacaggtctaaaagaaaattatgtccagagtcttccaaaacttcaaagaagcatcattccgatactgtgcactatggccaatccagttcttctaagaagcagatacttgactcggataaatcaaaacttaagaaatctctcatcattcataatgcttagaacatggacctgaaagaaggaaatgtctaccagagatgagcattctgaatataggatgaacactcttccagatgcctctcacactcctgtgaccatgaaatcagctctacttactgctgtggaacctcctttttcacttgacagtttctttttattgtttgcatagcatcttgttgtatgtgggtttctgtatttaactagtcccctattgatagacacttcagttcttcccaacttttcactattacaacatcatgtagtctgcagatctttgcaaaatatccaatgatcttatacagtagttttgatagttgaaaatatctttattttgcccttattgaaattatcaaaccacataaagcacagataagagtatgaagaacctctaagtacctatcacccagatctaccagttattaatattttgccactgtttcatctgttcctcacagacatgcttttttttgctataatcttttaaagcaaattcaagacatcatataattttacccataaacaccaaagtgtatatatttctaacataagatatagtatattttttaagaaaaaaagaatgtgtatatatatattacattttggggatctctactatatctctgcaggctcactaaatttcacttttgcttttatatgcaaattaacaggaagccctgaataaatgtaaaagctatttctcaacaaaactggagcctttattggggtggagatttctgtttccaccagtactcattagcatcttctgtgtgccaggcagtggggacaacactgtgtccatggcagaaatggatgagacagccgtggcctgagcccctgagtgctggtggtctagtctcaagcaaattcattctgggttcctggcacagacttagggatatgtatgtattgaagcatatgtccagaatgaccttctagtccatattacaaataaattatctaacatttgaaaaaaagagaaacagaagtggagcttctcagacaatgaatattattctggctttcaaacattttatatgtttgatatacgaaatattatataattgttgtaatatatttaaaagaaaccaaaatcttcattggctattccactgaaacaataattacataaaaatagccactagagatccaagtataagttgaactctgattttgtaaatgtgatttattgtctccaccactttactaaaccattgcaattaaaagcaaaagtaaacaaactctccttcaaacgttaaatgttaactcctgctcctgaaattgtgtttagttaattaatttgctatatacctttattgtaagcatttctgttttccagaattatctctatttcccaattattttaccattttcataaggataagcattttgtctgaagcccattttgagtgtgcttttctcattccaaagtttgtattatagatatctagtagactgttataaagagtggtatgtcattttgtttatgaggctatggtgaaaataacattagtaaatatgcatttttgatgagcacagtcatccacagcatgtaatcattcctaaaaccagccttccccactgttccatacattcccaggccaccttcctgctactgcccagtcactatgcctcaggtaatggacacttactttattattacactgagcaaaataatgaaaaccatacatccactgctgaagtggtattaacatcttccagttctttatataaataatcttgatagcccctcctatactccattagtgtctaaaatttagaatatatagtatagtacttgagtttagatcaatgttaacctacatggcaaaacctgccatgtttagtgtatttttttgtataaagtaggtttgatttttatcttacaatatttatcctaatgaaagttataaaaatatatgcatatatttatatgtgagatttaatatagataggtatatagattgttgatttcatatttcatgttccaagaagaggttctagatcaaatttctgtgttcagaatcaccagagaaatcaattaagattttggttcattttaaacattgcaatttttgaaagccaagataattccaaatctaattagggaaagctacattttacttctttgtgtaagttattggtgatttatatgcagtatggaccatcctccccccagaaattattcttatattccaattgtgcattagttttagaaccattttaattttaaaaccataagaaaataattttatgtttgcctatgtccaggagctgaagaaatcagcgattactttaaaaaatatatggcaatgtcaaaataaatgccaagaatcatatttctaggaatgcaaaagtgcttctcatatactcatatattaggtttcacagtattggttgcttactatatttgtttttatttttattatatatcataattacacatttttatttgcatttgttgcttattgtagtaaaaaggtaaaaaaaaaatgaacttgttaatgattagcttttatttgactaaccagttgaccaattttgctctgttttcaaattgcatatgatggggtattatgctgaaactgctaatatattgggtatttattgatacttaggaatagtcagtatttataaatatttaagaatgtcatggtccttatgttttgatgtttaaaatgttcactttgttgtacgttacatagtgtcttattcaaaattgaaaataataaaggtatttctaata
